United States Patent 7,745,391 (HUMAN THROMBOSPONDIN POLYPEPTIDE) - sequence listing, part 139

SEQ ID NO: 369951 - DNA, 1703 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369952 - DNA, 1016 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggatggttatgactactcatggaaaaagaatcgaatgtggagaaagaaccgttctttctatgcgaacaatcattgcatcggaacagacctgaataggaactttgcttccaaacactggtgtgcactattcacaagagcaaagacatggaatcaatctaggtgtctgtcaatggcggattggataaagaaaatgtggtaaatatacatcatggaatactacacagccataaaaaagaacaaaattatgtcctttacagcaacatggatgcagctgg

SEQ ID NO: 369953 - DNA, 1135 bp, Homo sapiens
gttatgcaatcaatgatctgggtttttctcttcagagaaatttgttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagatctattcttggatagaatttataactgagaggcatcctgatatgcttacaaaaatccacattggatcctcatttgagaagtacccactctatgttttaaagtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaatgatcatctcacgctgatcattggatcctactcaacaaaaggaagggtggtcagaagtacattaaagatttctgctccaaattttcaataaatttctgcttgtgccttt

SEQ ID NO: 369954 - DNA, 3204 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacag

SEQ ID NO: 369955 - DNA, 4632 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcattctggaccatgggaaccttgaaaaggcatggcagtggagaccagtaactagtatacagcttgcctgagaaggcttagtaacaaatgaattcaagtcgtattagatattctaaaccttccttaatataagatgaagtgtcatatgttaggaggtaaaaacgtaacacaaaattctgggaataagaataaagtctggaccctgagctcagaatgatccatagcatctactgtgcaaatatattacagcagacattatagcatattacctcctgctgtacacacatgcacaggcctgaaactctccaagagcaccataagaatgattccctttacctcatctagataaaggctgaaaaaaatgtattctgttgcagatgggagggaaaaaaatagacaattacgttgaaaatttattaaaacagaccagcttgaagtgagtttattcttgtctgtataatcaccaatgttatttccaaatgtccgtgaaattatctataatcctatctccttgcttgctttggtaggagtatagctaacaatatagccatcttttgccctcagtaagggctatcagcagttccaagctctgtgagattatttttgcccttcttttattcaactctagttgaataaagttacttccaatttgaaagctttagaagacccccccaaaactgttttggaagattgtctccctagagagtaagaacaaatggatagctctattccatttaaacctaatctctgacatcagaatagggatcatgctcagcaaatccaagagcaaggtcatttgtataccattgctctgacttcttcctagggtactcagtgccctactgccagctcagggtagagtggcagactttcctcctttctttcactctcagcagcattgaaactttgttcctgtagcattgcctgtgctaaagtgctataaaagggactttcttgggggcccaaaaaaaaaaagcattcagggaagaaggccaagatctatagccactctttggacataagtgagacagaagtacttctaactggcaagataatgtctgttcctgccaggattctgtcagttggcctctgaaggtaattatacaagctgtccctatggagctgttgccatctgtagaaacaagaagagctgaggtccttggaacagacgtgctgttctttacatggaggtaaggcttaattaagatgggtctaacaatgtgctggcttgagagtagccaactatggcgtgacagaagacaagttgagtggagaaactctgcgtgtgggggtattgttagcagagagtgaagcaggtaggaaaaagggagcaggcacctcggtggtaggagtctcgccttggttccgaagctgtaggatttgccggagtaaggccttaccttcttccc

SEQ ID NO: 369956 - DNA, 4433 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcattctggaccatgggaaccttgaaaaggcatggcagtggagaccagtaactagtatacagcttgcctgagaaggcttagtaacaaatgaattcaagtcgtattagatattctaaaccttccttaatataagatgaagtgtcatatgttaggaggtaaaaacgtaacacaaaattctgggaataagaataaagtctggaccctgagctcagaatgatccatagcatctactgtgcaaatatattacagcagacattatagcatattacctcctgctgtacacacatgcacaggcctgaaactctccaagagcaccataagaatgattccctttacctcatctagataaaggctgaaaaaaatgtattctgttgcagatgggagggaaaaaaatagacaattacgttgaaaatttattaaaacagaccagcttgaagtgagtttattcttgtctgtataatcaccaatgttatttccaaatgtccgtgaaattatctataatcctatctccttgcttgctttggtaggagtatagctaacaatatagccatcttttgccctcagtaagggctatcagcagttccaagctctgtgagattatttttgcccttcttttattcaactctagttgaataaagttacttccaatttgaaagctttagaagacccccccaaaactgttttggaagattgtctccctagagagtaagaacaaatggatagctctattccatttaaacctaatctctgacatcagaatagggatcatgctcagcaaatccaagagcaaggtcatttgtataccattgctctgacttcttcctagggtactcagtgccctactgccagctcagggtagagtggcagactttcctcctttctttcactctcagcagcattgaaactttgttcctgtagcattgcctgtgctaaagtgctataaaagggactttcttgggggcccaaaaaaaaaaagcattcagggaagaaggccaagatctatagccactctttggacataagtgagacagaagtacttctaactggcaagataatgtctgttcctgccaggattctgtcagttggcctctgaaggtaattatacaagctgtccctatggagctgttgccatctgtagaaacaagaagagctgaggtccttggaacagacgtgctgttctttacatggaggtaaggcttaattaagatgggtctaacaatgtgctggcttgagagtagccaactatggcgtgacagaagacaagttgagtggagaaactctgcgtgtgggggtattgttagcagagagtgaagcaggtaggaaaaagggagcaggcacctcggtggtaggagtctcgccttggttccgaagctgtaggatttgccggagtaaggccttaccttcttccc

SEQ ID NO: 369957 - DNA, 3232 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcggacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaaaatgtgaacgataatatctttaatataactgttttgtgtgcatgaaatcatatcacgtcaatgaagaacagttatattaaagatattattgttcacatttt

SEQ ID NO: 369958 - DNA, 2120 bp, Homo sapiens
tcagctaattcgtgggatgggaacctgcgtctgtggcaataccgccaggctgagtacttccatgattacgtgatcagcagtctcaggaatgtgcaagcgcccctgccccagtgccccaatcctctacacccttttcctcaccccagtagatccaacctccagccccatatagggtgaacctcttgataagctctctgcctcctcctccctttcttcccggattggcgaccatttcaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcattctggaccatgggaaccttgaaaaggcatggcagtggagaccagtaactagtatacagcttgcctgagaaggcttagtaacaaatgaattcaagtcgtattagatattctaaaccttccttaatataagatgaagtgtcatatgttaggaggtaaaaacgtaacacaaaattctgggaataagaataaagtctggaccctgagctcagaatgatccatagcatctactgtgcaaatatattacagcagacattatagcatattacctcctgctgtacacacatgcacaggcctgaaactctccaagagcaccataagaatgattccctttacctcatctagataaaggctgaaaaaaatgtattctgttgcagatgggagggaaaaaaatagacaattacgttgaaaatttattaaaacagaccagcttgaagtgagtttattcttgtctgtataatcaccaatgttatttccaaatgtccgtgaaattatctataatcctatctccttgcttgctttggtaggagtatagctaacaatatagccatcttttgccctcagtaagggctatcagcagttccaagctctgtgagattatttttgcccttcttttattcaactctagttgaataaagttacttccaatttgaaagctttagaagacccccccaaaactgttttggaagattgtctccctagagagtaagaacaaatggatagctctattccatttaaacctaatctctgacatcagaatagggatcatgctcagcaaatccaagagcaaggtcatttgtataccattgctctgacttcttcctagggtactcagtgccctactgccagctcagggtagagtggcagactttcctcctttctttcactctcagcagcattgaaactttgttcctgtagcattgcctgtgctaaagtgctataaaagggactttcttgggggcccaaaaaaaaaaagcattcagggaagaaggccaagatctatagccactctttggacataagtgagacagaagtacttctaactggcaagataatgtctgttcctgccaggattctgtcagttggcctctgaaggtaattatacaagctgtccctatggagctgttgccatctgtagaaacaagaagagctgaggtccttggaacagacgtgctgttctttacatggaggtaaggcttaattaagatgggtctaacaatgtgctggcttgagagtagccaactatggcgtgacagaagacaagttgagtggagaaactctgcgtgtgggggtattgttagcagagagtgaagcaggtaggaaaaagggagcaggcacctcggtggtaggagtctcgccttggttccgaagctgtaggatttgccggagtaaggccttaccttcttccc

SEQ ID NO: 369959 - DNA, 393 bp, Homo sapiens
gccccttctgtccctaaaggttcttctccctgcccactttttggtctctttttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggtaaaggaactggggagtggctggggcggaaagtgatatcctcaggccaataattgtccatacagggtagtatgaggtcaaagactagcaatcctaaaggtctgagatcaattcaaaattaagggcatttaggacaaaatggctatgaaaag

SEQ ID NO: 369960 - DNA, 5089 bp, Homo sapiens
cgccccctttccttacgcggattggtagctgcaggcttccctatctgattggccgaacgaacgcagcgcgtaatttaaaatattgtatctgtaacaaagctgcacctcgtgggcggagttgtgctctgcggctgcgaaagtccagcttcggcgactaggtgtgagtaagccagtatcccaggaggagcaagtggcacgtcttcgggtgagtgtgcggctgtgctggagcccgggttaccagctcttgcccgcgcggaataggctttaagaaatcggagctgcagccatctgtttttctcttaatgctgcatctctgttctcacggtggtccttggggtgaggttagagaaggagccgagggatcctgacaccacctccacagcaccggcgggcgaggtgccctactttaggcgtagccttctgcttttggagccagatgtctgtggacttctgttcgcgttcagaaatgccgcctcaaacttctctcaattgttcattaagtgaacttctctcattcccttcccctttgccgataattggaggggaaaagaagtaggaagcgggacacggtgtcctggggcaagggacttattacctaaaattcgcggccccttctgtccctaaaggttcttctccctgcccactttttggtctctttttagacctaggctgcccctgccgtcatgtcgcaagggatcctttctccgccagcgggcttgctgtccgatgacgatgtcgtagtttctcccatgtttgagtccacagctgcagatttggggtctgtggtacgcaagaacctgctatcagactgctctgtcgtctctacctccctagaggacaagcagcaggttccatctgaggacagtatggagaaggtgaaagtatacttgagggttaggcccttgttaccttcagagttggaacgacaggaagatcagggttgtgtccgtattgagaatgtggagacccttgttctacaagcacccaaggactcttttgccctgaagagcaatgaacggggaattggccaagccacacacaggttcaccttttcccagatctttgggccagaagtgggacaggcatccttcttcaacctaactgtgaaggagatggtaaaggatgtactcaaagggcagaactggctcatctatacatatggagtcactaactcagggaaaacccacacgattcaaggtaccatcaaggatggagggattctcccccggtccctggcgctgatcttcaatagcctccaaggccaacttcatccaacacctgatctgaagcccttgctctccaatgaggtaatctggctagacagcaagcagatccgacaggaggaaatgaagaagctgtccctgctaaatggaggcctccaagaggaggagctgtccacttccttgaagaggagtgtctacatcgaaagtcggataggtaccagcaccagcttcgacagtggcattgctgggctctcttctatcagtcagtgtaccagcagtagccagctggatgaaacaagtcatcgatgggcacagccagacactgccccactacctgtcccggcaaacattcgcttctccatctggatctcattctttgagatctacaacgaactgctttatgacctattagaaccgcctagccaacagcgcaagaggcagactttgcggctatgcgaggatcaaaatggcaatccctatgtgaaagatctcaactggattcatgtgcaagatgctgaggaggcctggaagctcctaaaagtgggtcgtaagaaccagagctttgccagcacccacctcaaccagaactccagccgcagtcacagcatcttctcaatcaggatcctacaccttcagggggaaggagatatagtccccaagatcagcgagctgtcactctgtgatctggctggctcagagcgctgcaaagatcagaagagtggtgaacggttgaaggaagcaggaaacattaacacctctctacacaccctgggccgctgtattgctgcccttcgtcaaaaccagcagaaccggtcaaagcagaacctggttcccttccgtgacagcaagttgactcgagtgttccaaggtttcttcacaggccgaggccgttcctgcatgattgtcaatgtgaatccctgtgcatctacctatgatgaaactcttcatgtggccaagttctcagccattgctagccagcttgtgcatgccccacctatgcaactgggattcccatccctgcactcgttcatcaaggaacatagtcttcaggtatcccccagcttagagaaaggggctaaggcagacacaggccttgatgatgatattgaaaatgaagctgacatctccatgtatggcaaagaggagctcctacaagttgtggaagccatgaagacactgcttttgaaggaacgacaggaaaagctacagctggagatgcatctccgagatgaaatttgcaatgagatggtagaacagatgcaacagcgggaacagtggtgcagtgaacatttggacacccaaaaggaactattggaggaaatgtatgaagaaaaactaaatatcctcaaggagtcactgacaagtttttaccaagaagagattcaggagcgggatgaaaagattgaagagctagaagctctcttgcaggaagccagacaacagtcagtggcccatcagcaatcagggtctgaattggccctacggcggtcacaaaggttggcagcttctgcctccacccagcagcttcaggaggttaaagctaaattacagcagtgcaaagcagagctaaactctaccactgaagagttgcataagtatcagaaaatgttagaaccaccaccctcagccaagcccttcaccattgatgtggacaagaagttagaagagggccagaagaatataaggctgttgcggacagagcttcagaaacttggtgagtctctccaatcagcagagagagcttgttgccacagcactggggcaggaaaacttcgtcaagccttgaccacttgtgatgacatcttaatcaaacaggaccagactctggctgaactgcagaacaacatggtgctagtgaaactggaccttcggaagaaggcagcatgtattgctgagcagtatcatactgtgttgaaactccaaggccaggtttctgccaaaaagcgccttggtaccaaccaggaaaatcagcaaccaaaccaacaaccaccagggaagaaaccattccttcgaaatttacttccccgaacaccaacctgccaaagctcaacagactgcagcccttatgcccggatcctacgctcacggcgttcccctttactcaaatctgggccttttggcaaaaagtactaaggctgtggggaaagagaagagcagtcatggccctgaggtgggtcagctactctcctgaagaaataggtctcttttatgctttaccatatatcaggaattatatccaggatgcaatactcagacactagcttttttctcacttttgtattataaccacctatgtaatctcatgttgttgtttttttttatttacttatatgatttctatgcacacaaaaacagttatattaaagatattattgttcacattttttattgaattccaaatgtagcaaaatcattaaaacaaattataaaagggacagaaaaattaagaatcaaacatcattctggaccatgggaaccttgaaaaggcatggcagtggagaccagtaactagtatacagcttgcctgagaaggcttagtaacaaatgaattcaagtcgtattagatattctaaaccttccttaatataagatgaagtgtcatatgttaggaggtaaaaacgtaacacaaaattctgggaataagaataaagtctggaccctgagctcagaatgatccatagcatctactgtgcaaatatattacagcagacattatagcatattacctcctgctgtacacacatgcacaggcctgaaactctccaagagcaccataagaatgattccctttacctcatctagataaaggctgaaaaaaatgtattctgttgcagatgggagggaaaaaaatagacaattacgttgaaaatttattaaaacagaccagcttgaagtgagtttattcttgtctgtataatcaccaatgttatttccaaatgtccgtgaaattatctataatcctatctccttgcttgctttggtaggagtatagctaacaatatagccatcttttgccctcagtaagggctatcagcagttccaagctctgtgagattatttttgcccttcttttattcaactctagttgaataaagttacttccaatttgaaagctttagaagacccccccaaaactgttttggaagattgtctccctagagagtaagaacaaatggatagctctattccatttaaacctaatctctgacatcagaatagggatcatgctcagcaaatccaagagcaaggtcatttgtataccattgctctgacttcttcctagggtactcagtgccctactgccagctcagggtagagtggcagactttcctcctttctttcactctcagcagcattgaaactttgttcctgtagcattgcctgtgctaaagtgctataaaagggactttcttgggggcccaaaaaaaaaaagcattcagggaagaaggccaagatctatagccactctttggacataagtgagacagaagtacttctaactggcaagataatgtctgttcctgccaggattctgtcagttggcctctgaaggtaattatacaagctgtccctatggagctgttgccatctgtagaaacaagaagagctgaggtccttggaacagacgtgctgttctttacatggaggtaaggcttaattaagatgggtctaacaatgtgctggcttgagagtagccaactatggcgtgacagaagacaagttgagtggagaaactctgcgtgtgggggtattgttagcagagagtgaagcaggtaggaaaaagggagcaggcacctcggtggtaggagtctcgccttggttccgaagctgtaggatttgccggagtaaggccttaccttcttccc

SEQ ID NO: 369961 - DNA, 3047 bp, Homo sapiens
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369962 - DNA, 3237 bp, Homo sapiens
ccaccttacccaccttcatgtttcttttcaagctcgcacagccgtgcaggctctagcaaaaggctggggggtccccagcgacccccatcagctttgataaggggatccggagggtgccagtgggtcatctgctgtgtccacacattaagaaacgctggtggagttttaaatgcctctccggggaaggaggaaagcctgagaatgaatctgacctcagacccaaatccattcaacggagttctggtaatttggaagaaggaagagcaacctggaaactgacaggaaaggatgacaagttgggagtcacaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369963 - DNA, 2902 bp, Homo sapiens
  misc_feature (21)..(21): n is a, c, g, or t
  misc_feature (23)..(23): n is a, c, g, or t
aaaacctaggctagtacgagncnggtggtgaatcggccgaggctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369964 - DNA, 2962 bp, Homo sapiens
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgtatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369965 - DNA, 2055 bp, Homo sapiens
ctgtgcctaggggggcacgagctatgcccagactactttgggtatcgtatggagtggaggtctcactatattgccaatgccagtcttgaactcctggcctcaagctatcctcgctatctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369966 - DNA, 1961 bp, Homo sapiens
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcggactagtcgggggggtccgagctcgaatt

SEQ ID NO: 369967 - DNA, 1520 bp, Homo sapiens
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatcccccccccaagaagaactgaataaagattaatgagcaaaaaaa

SEQ ID NO: 369968 - DNA, 1035 bp, Homo sapiens
ggcacgagggggaaaaggaggaagagggagttaaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369969 - DNA, 2819 bp, Homo sapiens
  misc_feature (21)..(21): n is a, c, g, or t
  misc_feature (23)..(23): n is a, c, g, or t
aaaacctaggctagtacgagncnggtggtgaatcggccgagggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369970 - DNA, 2051 bp, Homo sapiens
gggactataggcatgcaccaccatgcgcagctaatttttttattttttgtagagaggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaaa

SEQ ID NO: 369971 - DNA, 1992 bp, Homo sapiens
  misc_feature (1961)..(1961): n is a, c, g, or t
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtnaaaaaaaaaaaaccaaggaagtataccttgt

SEQ ID NO: 369972 - DNA, 1437 bp, Homo sapiens
tgggggcgggccgggggcggagcgcggggcgccggctgctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgtcgggctagtcggggccggggcagcagctgtcgggctagtcgggg

SEQ ID NO: 369973 - DNA, 418 bp, Homo sapiens
acgctcaggatggggacgagacagcaattgctccaagaccgacgcatcttctcacgtgggccaggctttcacgcagccaaagcagatccgcgggggcgaaaacgattgacaaccggcctcatgacccaggcagagacacagaaagaggttcaacaaagacaggccgccatgcaagagacagctctgtggttcacagggcatattcagccaaagacacacaagcacacgggcacacacacacaaacccacagagagtgggaaagaaacacacagagactgagagacagagagagaagggagaatgggagacacacacacacacaaacaaagggtcatacagcagaggcattgaaacacacaccaccaggcaacccctgaggctgcggggttctgctgtcaaccagaacgaccctcgggt

SEQ ID NO: 369974 - DNA, 1207 bp, Homo sapiens
ccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctaatggagtttcactctgtcgcccaggctggagtgcagtggcacgatctcggctcactgcaagctccgcctcccgggttcacaccattcttctgcctcagcctcccgagtagctgggactacaggtgcccaccaccacgcctggctaatttttttgtatttttaatagagacggggtttcatcatgttagcaggatggtctcgatctcctgacctggtgatccacccacctcggcctcccaaagtgctgggattacaggcatgagccactgcgcctggcctagttatgctatctttcaaagaaagaccaatttcaactatttcatgaccatgcacttacacaatctgtggaattatctttggtgataaaaagttgtgtaatttgtattctcttcagataggcaaagagtgactggataaccgatttgcgacatgccactcatgatatttccaaagcctatggacatttgactttggaaacagggtcagcttagtcttcagacaccgtatttgcttaggataattttgtttgtttgttttttcagacagagtcccactctgtcacccaagctggagtgcagtggcacaatcttggctcactgcaacctctgcctcccaggttcaagcgattctcttgcctcagcctcctgagtagctgggactacaggcgtgcaccaccacacccagctaatttttgtgtttttagtagagatgggttttcaccatgttggccaggctggtctcgaactcctgacctcaggtgatccacccaccttggcttcccaaagtgctgggattataggcatgagccactgtgcctggctagctt

SEQ ID NO: 369975 - DNA, 4797 bp, Homo sapiens
gataccctttacactagattagcaggcaaaactatgatggtttgtgatatccatgcttgtagaagtaataagaagaaagggaacacagaagctttattttatagtggagtcctgactctaggccttaataattgcatggttttggagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattacatatgggcctgtatattgtgtgtgtatatacacagtaagtcctcatttgtccatagattcttggaaactgctactttaacaacttttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctca

SEQ ID NO: 369976 - DNA, 5152 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattacatatgggcctgtatattgtgtgtgtatatacacagtaagtcctcatttgtccatagattcttggaaactgctactttaacaacttttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctca

SEQ ID NO: 369977 - DNA, 5094 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattacatatgggcctgtatattgtgtgtgtatatacacagtaagtcctcatttgtccatagattcttggaaactgctactttaacaacttttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctca

SEQ ID NO: 369978 - DNA, 2705 bp, Homo sapiens
ggtcttgaactcctggcctcaagtgatcctcccacctcagcctcccaaagctctgggattataggtgtgagccactgcacccagctacctacatgatctcctaattcccactaaatcctgagactacaaggtactgatcatttcagatgttccctcaaagtcatctgaaaaactgctttctaggaacactcttattttgttatatgagatccagccatgcaataggttccaatttgtgtttcaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattacatatgggcctgtatattgtgtgtgtatatacacagtaagtcctcatttgtccatagattcttggaaactgctactttaacaacttttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctca

SEQ ID NO: 369979 - DNA, 3849 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagacttgatcgatctgtggactggactgacctggattgacagatgtctatc

SEQ ID NO: 369980 - DNA, 2048 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcagcctgggagacagagtgagactccgtctgaa

SEQ ID NO: 369981 - DNA, 1792 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgggaatatctggagaggacatttgccttacatcccaattcacgtaaccaggagttttaaaagctgatgtttctgttgcgtggg

SEQ ID NO: 369982 - DNA, 928 bp, Homo sapiens
ccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatatatcttttcaactactgtgtaatttttacaatcataaatcaagctctgtatttagatagagtgtctatccaaagccagtaaattaagatgaataaatagtctttggttatcca

SEQ ID NO: 369983 - DNA, 4308 bp, Homo sapiens
gataccctttacactagattagcaggcaaaactatgatggtttgtgatatccatgcttgtagaagtaataagaagaaagggaacacagaagctttattttatagtggagtcctgactctaggccttaataattgcatggttttggagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagta

SEQ ID NO: 369984 - DNA, 5166 bp, Homo sapiens
ccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccacgacaaaaccaccctagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatctaagtacagaaaagctttttgtgtgtttaaaaaaattgaagaaaattcaggaagaaacgtgttaataaacattgtactgttcttttgcttctcaaaggaattattcacttgccactttggttatttttgagttttcgtacataggaagttttatattgccagccttcctgtgataaagatattaaatgtaacttgagtaaaaaataaaaaagaataactatgtatatacatatataaattacatatgggcctgtatattgtgtgtgtatatacacagtaagtcctcatttgtccatagattcttggaaactgctactttaacaacttttttttctcatcaacgttgtaatgaaaggaaattgaatgaaattaccttgtggaggaccagtttgaacacttcatttgacttaaagttgctatttccaagaatctacagaccatgttaagtgaggacttacttactgtatacacacacacacacacacacacacacgcacacccccctattattactttgctgaagactaatttaagtctataacaaaactgccttataattatgattatatcatttactgacaaccagtgactctgatgtttccaatctatcaatttcccatcatcagtaaaataaaataggcaaatccacgatggggcaaaaagaacaatcacaattgactcctcctca

SEQ ID NO: 369985 - DNA, 4466 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggagtctgtatttagaaactatgatcacgaccatgatgggtacatttcccaagaggactttgaaagtatagctgccaattttcccttcttggattccttctgtgttctggacaaagatcaggatggcctaattagtaaagatgaaatgatggcttacttcctgagagctaaatcccaactacactgtaaaatgggaccaggatttatccataattttcaggagatgacctatctcaagccaaccttctgcgaacactgtgcgggatttctctggggcataatcaagcaaggatacaaatgcaaagactgtggagccaattgtcacaaacagtgcaaagacctcctggttctggcctgcaggagatttgcccgggcgccctccttgagcagtggtcatgggtcactgcctggaagcccctcgctgcccccagcgcaggatgaggtgtttgagttccctggagtcactgctggacacagggatttagacagcagagccatcacactggttacaggctcttctcgcaagatctctgtgaggctacagagggccaccaccagccaggccacccagactgaacctgtctggtcagaggctggctggggggactcggggtcccacaccttccctaaaatgaaatccaagttccatgacaaagcagcaaaggacaaaggctttgccaaatgggaaaatgagaagcccagggtgcatgctggtgtggatgttgtagaccggggcacggagtttgaacttgaccaggatgaaggagaagagaccagacaggatggtgaggatggctgacttcaggctgcggaaactgaaggcaataatgttggcttttggaaggggcaagacgagaaactctgaagaaagctctgactctcaggaagttatctggaaagatacctggatgtttactgccttgggacactgtgggatctccatgtttggactatgggacagagaattgaccctaactaactatgaactatttatttcctcctcccctacccctagttaagtgccacaaagactgtgttatgtagtcagtacttttctcatgtatctttctctagaccatttatatacgggtgaaatgaaagcttttttgcatgtacttgatactcagtctgtaaactcagacttcgctttttttgtgagactatcctttcaatatttttataaacttttgtgtgtgctgtggcagggaacagttaacaaggagtttatttagaggggtttttttcattttttgtttttcttgttttgttttgttttgttttgttcttcttggtgtgctttttggatgggaccagaacttaacattttcctgaggactaggaagctcatcagacactggaatgcagtgattcttctaatgatggtcaactgcaaggagaaactgtttacatccttcccactacacagttgctatgatatgtaacaagtcacacatgtatatatcacacaagtcttaccaattctgcgtcactaggaagctatagcatggtcgtgaaagctctcctaatacttacttaaatagccatggaagaaaattatgcttgtcccttctgactgggttaagccatctttcttaagattcctgaagtagaaatagcaattaagaaattaattcaagttttgacggttaacatttagcagaaaaacaaaccattgaataagctactaggtgaaatgcaaaacaaccatcaatttttttaaactcaataattttgtgaaaaaaaaaaccaccaccaaacttttggttgtaaaagagaacccttgttcccttcctaagaaactgccttccacaattaaagaatactcatagaaagaaaataatcataaatcatatttgattaacatttcatttaagcttttaaaatatcaattttttaaatagctcccatttacccaaaataactagttatgggtctatttcttccatgattagaggagagagaacttgattcaagatactgaaaaatagagctgggactgagcctgtgaatgacaggaatgatctattaccaggtgactagtcggaaactacacagaggtgcactggtctgcatttgggggctaaagtgtatatattccatttaaaatggaatttgtttgtatttggggcagtcttcagtaaagcctttctcctttcttttctccattgaggacagttctgctcagcaaaattgttgagtacctgttctgggcaggtcccacgctatatgcacaaagttaagaaaaacttggtcttagcccttgggagctgacagcccatgggcattaaggcaaagtagttccagtgatttaaaatacggttccaaatacgctaaaaccaacttgtgccaaccagatttacagattggaaatactgcagatgatgtgaagttatcagttggaggagctgtgattaagctggataataagagaacgtgccatctgtaaagcactcagaaggcagccatccctagatgttggtttcatgtatattacactatctactactatccataaatgcaataatatgcatgttaacaacattaaaaacagcaaacagcaatcta

SEQ ID NO: 369986 - DNA, 2684 bp, Homo sapiens
ttgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaagagaaacttgctagaggtgatgaagtggaaagaaaaagacaattcactatagggatcaacattattgcagttctgcaaaggatattttcttttaaaacatccatatctcttctttgccatggaaactacacccaatctacctgaacctgcggcacccctctgatgacccatttggattctctgatttcactgccaagattctcagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatttatcttccactgaattggcagaaaaacttctctgcatgtatcgaaatgccactggagaaagctgcaatgaatttcgattaaagatctgctacttcatgaggtactggattctgaagtttcctgcagagtttaatttggatcttggtttgattcgtatgactgaggaatttcgggaagtagctagtcaactaggatatgaaaaacacgtcagcctcatcgacatatccagcattccttcctatgactggatgagaagagtcacacagaggaaaaaagtatccaagaagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaaccccccagcaaagggcagaagtcatcacaaagtttatcaatgttgcaaagaagctccttcagctcaaaaattttaacaccctgatggcagtggtgggaggcctcagtcatagttccatttcacgcctcaaagagacccattctcatctttcttcagaagttacaaagaactggaatgaaatgacagagttggtctcctccaacggcaattactgcaattaccgcaaggcctttgccgactgcgatggcttcaaaatccccatccttggagtacacttgaaagacttgatagctgtccatgtcattttcccagactggacagaggagaacaaagtgaacattgtgaaaatgcaccagctctccgttaccctgagtgaactagtctccctgcagaatgcctctcaccacttagaacccaacatggatttgatcaacctgctcacgctttccctggacctctatcacactgaagatgatatttacaaactgtcactggtgctggagcctagaaattctaaatcgcagcctacctcccctacgacgcccaacaagcctgtggtacccctggagtgggcattaggggtgatgccaaagccagaccccacggtcatcaacaagcacataaggaaattagtggaggtaagtggttgagggagaataaagagagggcactagaagaccctttctctttccagaatgttctgcgattgtccaggaatctgatggaacccctgaaaacaaccctctggcaggtaggaacaatttagcaggcacttagtcctaccaggcattgggtcctggggagagtcgatcagaaaggcccttttccctttgttgtctctcttgcccagatactctcagctacttccagctcctctctttcacaggcatttgccacctctgtcattgtcaacagctcaagggattggggattagaatcactcatgaaaaacccacataggtcccactaagatgcccaataaattgattacccaagggcaggaaagaaatcctgtaagttggatagtttctccttttgtatagttttggaattttatgacacagcagcccgatgttattgagattagaaaaatcacctaatgtaggacaaggctctgtcagagttttccgtgtagaaaaaagagtagggccgggcgcggtggctcacgcctgtaatcccagcacttgggaggccgaggcgggcggatcacgaggtcaggagatcgagaccacggtgaaaccctgtccctactaaaaatacaaaaaattagccgggcgcgatggcgggcgcctgcagtctcagctactcaggaggcagaggcaggagaatggagtgaacccgggaagcagagcttgcagtgaggtgagatcgcgccactgcactccagcctgggagacagagtgagactccgtctgaa

SEQ ID NO: 369987 - DNA, 813 bp, Homo sapiens
taaaataggaaacaaaatcatcaggagtggagatagtgtgatgacatttgagaagagaatggaggaaaactgtggaggaatggggaccaggctggtctcagaatcctggcctcaagcaatcctcttgccttggcatcccaaaatgctgggattacagggatgagctatcccaccagggacccctcaggcagattgatttcttatgtgtgttcagctctggaggccacattccaacacctgttgtttcctgactttttaatgatcgccattctaactggtgtgagatggtatctcattgtggttaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaccccatcaaaagtgggcaaaggatatgaacagacactctcaaaagaagacatttatgcagccaaaagacacaagaaaaaatgctcatcatcactggccatcagagaaacgcaaatcagaagaagactctttaatctatttttttctctctagttaaacattttaagacagagccgttttttataaattctaccctatataagaaacttaacatgcatttatttcctttttcctttcctccaattttcagtttttgttgacaaaactgattataatacttttaaagtatgacaggtattttatttcaaaaattcttatttacatttatattgttttgtaactatgccaacaataaacccagat

SEQ ID NO: 369988 - DNA, 429 bp, Homo sapiens
ctccaattttcagtttttgttgacaaaactgattataatacttttaaagtatgacaggtattttatttcaaaaattcttatttacatttatattgttttgtaactatgccaacaataaacccagataaacaaaaagctgagttcaaataatctgttctgcaaagcaccccgacttctcagcaatatacagacttaattctctgtactggtcactgttgcctctatattcttcttctactttgaattatgtgttattctgtaggcttcacattgttttgtttgctattctacctcacaaggttatgagttccagaagggcaggactctcatctcattttcatttttatacgctcagtacttggcacttagtagtagttaattttagtaatagattgctttccatgtaccaggcagtgtcttcagggattt

SEQ ID NO: 369989 - DNA, 1257 bp, Homo sapiens
gcggccgcctccgcgagcccacagcgccacctggggaccggaggccgctggcccgcggccgggcgagcgtgcaggaatgtgagcggcgcttccctgcttcgcgccgggcccgggtttgggagtcgtttgaggcgcgagcttcctgcgcctgctcagcagcctgaggccgcggccgggtgccctcctgccctcctggccatccagggattgggtgtcagtggcctgttgcacattgtcacttctacaagtgactaacaccgtcaggataatctaaaactacgaatactacctgactccacaagggtacggtgtattctccagttttagcatctgccttaaaaattacctcagagttaagcactgctggggacttatttctactcttgttttccttctaacaggtccctcagctgtaggtctgttggagtttgctggaggtccactccagatgctgtttgcctgggtatcagcagtggaggctgcagaacagcaaatattgcagaacagtaaatattgctgcctgatccttccctctggaagcttcgtcccagaaggccacctgcctatatgagttctagatccctgaggaatcgccacactgacttccacaatggttgaactagtttacagtcccagcaacagtgtaaaagtgttcctatttctccacatcctctccagcacctgttgtttcctgactttttaatgatcgccattctaactggtgtgagatggtatctcattgtggttaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaccccatcaaaagtgggcaaaggatatgaacagacactctcaaaagaagacatttatgcagccaaaagacacaagaaaaaatgctcatcatcactggccatcagagaaacgcaaatcagaagaagactctttaatctatttttttctctctagttaaacattttaagacagagccgttttttataaattctaccctatataagaaacttaacatgcatttatttcctttttcctttcctccaattttcagtttttgttgacaaaactgattataatacttttaaagtatgacaggtattttatttcaaaaattcttatttacatttatattgttttgtaactatgccaacaataaacccagat

SEQ ID NO: 369990 - DNA, 710 bp, Homo sapiens
gaggagtctgtgagccaagaagggaaagtgtgacatctattcagaggatagtgagtaaagggttttggctgaatcagagagtcctaggaggcaatttctgggaaataaagctggacatttaagttaaagccagatggtggagaatataaagcaccagacagaagagtctgggtcatgttatgctaccatgatttctgtgggtgaaaaccagactctgagagaccaactggaagtcactgtagttatccaggtgtgaagtgataaaaatcttgtcctaaggtggagacagtgatgaaattagcaacatgacttcttaacaaacaattgattctctgaatgatggaggcaaaatggcttcaaaattacagatctgcatgtttagcatatagcagtacttgctatttctagatttacagaagaaggatctaattttgagaagatcttgaaccagcctttagacacaagtattttcatataaaagatatatagatatgggaatataggaatgtcctttggaaatgaggaattgaaacccaagaagtcagggctggagatagagatttgagagttatgcaaatatactcagatcatgttcaagatcacacaggactatgagatttacaactgagtgtatttgttgaagcaagtagaaagctgaggccagggctcctggtgggtggggaggaaaatcaacaaagattttcttttga

SEQ ID NO: 369991 - DNA, 396 bp, Homo sapiens
gggtatattgggatgtagcccatcgtaaagatgagcatatcatctgtatatttttatgttttttagctctaaagactattaaatatgaacatacttgagaaactacttaatctagctgggggtggtggctcaccctataatcccagggatttaggaggccaaggcaggaggatcacatgaagccaagagttcaaaaatagcttaggcaacatagcaagaccctctccctacaaaaaaaaattaaaaaaatagccatgcgtggtggcatgtacctgtagtcctagctacttgggaggctagggcaggaggattgcttgaacccaggagttcaaggctgcactgggctgtgatcacaccactgcactccattctgggcaatggagtgagaacctgtct

SEQ ID NO: 369992 - DNA, 2564 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgcca

SEQ ID NO: 369993 - DNA, 2448 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatt

SEQ ID NO: 369994 - DNA, 2235 bp, Homo sapiens
agcccgggggcggggcgaacggggcgggggccggggtctggtaaggccccgccggctgagatatccagcggcgcacctgacttcccgggaggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgcca

SEQ ID NO: 369995 - DNA, 2343 bp, Homo sapiens
agcccgggggcggggcgaacggggcgggggccggggtctggtaaggccccgccggctgagatatccagcggcgcacctgacttcccgggaggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttgattagtagttt

SEQ ID NO: 369996 - DNA, 1609 bp, Homo sapiens
ggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgcca

SEQ ID NO: 369997 - DNA, 1892 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagatggagtctggctctgtcgcccaggctgcaatgcagtggtatgatctaggctcactgcaacctccacctcctgggttcaagtgattctcctgcctcagcctcccaagtagctgggactacaggcacccaccaccatgcctggctgatttttgtatttttagtagagacgaggtttcaccatgttgactgggctggtctcaaactcccaacctcagatgatctgcctgcctcagcctcgcaaataagaatatatttcagtgtcttcttgtttactagctttgtttctattaatggcagttctccaaaatcttcaagagctacactttgggaactttccatttattgtatactttaattaaaggtttccaactgattttaaattaaa

SEQ ID NO: 369998 - DNA, 2726 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttgattagtagttt

SEQ ID NO: 369999 - DNA, 2511 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgcca

SEQ ID NO: 370000 - DNA, 1883 bp, Homo sapiens
agcccgggggcggggcgaacggggcgggggccggggtctggtaaggccccgccggctgagatatccagcggcgcacctgacttcccgggaggcaaggccaacgtggttggaggcggggctgggttggggggtgggggttcaagtctgagagacctaaaggcaccgctagcgtatgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccctggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtgcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagaaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgcca

SEQ ID NO: 370001 - DNA, 5414 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaaca

SEQ ID NO: 370002 - DNA, 4709 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttatataaatatatatataatcatatatttcttttgggtggtctcgtccgtattatctctccatatgtatttaatttattccctttggggggg

SEQ ID NO: 370003 - DNA, 3008 bp, Homo sapiens
ggacagcggctgcagcgggggcgccggctgggagatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaaca

SEQ ID NO: 370004 - DNA, 4619 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaatttttta

SEQ ID NO: 370005 - DNA, 5424 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgagggaggggtggtgtgtgtgggtgggtggtgtgtggtgtgtgttgtgggggggggtggggggggggggggggggttcagcaatttttttttgtttcattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaaca

SEQ ID NO: 370006 - DNA, 5319 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaaca

SEQ ID NO: 370007 - DNA, 5161 bp, Homo sapiens
ctctgtggacctgcgcgtctcggggatgcgggagcgggggcagggggcggcccgagggcctgatccacgcggccccggatgcccgcgtcgggaggcggcgcgtcgggccgaggaggggcttctctgtggctgcagtagtttgttctctgggtcgtctttggagtggccgagcggcgtccgggcgctggggcggccaagtggcgcgggaagggtgggaggtgccgtgagggcggcgaggacagcggcggatttaagccccactggaaaccccggcccttgtggccgtggactgggctgcgggtagcagcgtctcctggaagggctctggccccgtgagcctcggggattcaggggccgccgacgttggtgcagatgccgggcgcactgggaggcggccggaatgccaatgagattcggcggatacgcagctgtcaccggccgcagactgccctgtcgccacctccagtgcctgcactccagtagccaagcaacataggaaatcgcgctcagaacccactttgttgattgagaaatcagacacgttgaatccgaggtgacatctgtggtctggccgaaggaggctagaaggaaggcatgtgctttggatggatggaaacaggaatcaaagaggaagctgtttttggaaggaagaaagatggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacagatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccaggatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggagttcatttttgggaaaca

SEQ ID NO: 370008 - DNA, 524 bp, Homo sapiens
atagggaatcaagacaccaagccacttcagccataaatcttattcttgcacctttttttcttgctagtaattttatatagcaggttgagaaagctactctatgctagtatagactatacaccaataattttgataatgagttctaggatgtatttttcttgtatctttttcttcctactatgatactagtaattcataagggatctgtgtaatctgaatgtatttgaataactttagctctactgtttgatttgacccaaagaagccaagatgatataagtattcccatgtgtcttagaagcccaaagtcagtgagatgaaacccaacatcaagaaattgaagcaaagttacttatggataaagaaagcattaggtagttgggctatagcataattagattttctggctttcaaaaatttggattgcaatcacagcaaactttgttatttttacagttttcagtacaaaagtgtttatatagaaacaataaagttgacatttgagtaccttttaaaaattgttc

SEQ ID NO: 370009 - DNA, 531 bp, Homo sapiens
cctcagtgcagtttattcctgggtaacggagcccttgccctgccagtaccaccctgggagctcctctgctctatggtgctcatcactggatcccttcctttagtggggccaaacttagttggtcaccaaatcttagtctaccacagaaatggtttttgcttttgaatctggtttcccctctctttctccactgccttttgttttttcgggtccctgttatctctcacctggtgtcttgccacaaacttctgactgttctgtttcttttcttcctcttttccttccaagtctgtcctcagcataatcaccagagtgatcatcttaaaaaaaaaaaaaaagaaaaaaaaaacctggccaagttatgttaatgctttaaaacctggctacgtgttgtctgtagatttaagtccaagtgtgacatacaagtaagtttttttgggatctggaggatgaggagagatgtaggtaagtttcctgtccctggagtaaaacctggcacactttttgctatgggtgttatgtagaagacaa

SEQ ID NO: 370010 - DNA, 471 bp, Homo sapiens
aggtttttccccagtcccgccgttgtaaaccgccgcccagtgatttgtaatccccctcccctatagggcgatttgggacccgggcccccccctcaagttttttttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370011 - DNA, 365 bp, Homo sapiens
agtaggtctagtacgaggctgggtgggctgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370012 - DNA, 427 bp, Homo sapiens
agtggaacgcctacatgagtcttgatcctcggcaggcaccgtacccagtttcctccgttgggagggtttaactgcccggaaacggaagtctcgttcctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370013 - DNA, 356 bp, Homo sapiens
gctgcaggaattcggacgaggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370014 - DNA, 570 bp, Homo sapiens
  misc_feature (11)..(11): n is a, c, g, or t
  misc_feature (22)..(22): n is a, c, g, or t
ggagcactccncccaggctggnagtgtagtggcatgatctcggctcactgcaatctctgcctcccgggttcaagcttgtccaggttgatcttgaactcctgacctcgtgatctacccactcggcctcccaaaatgctgggattacaggggtgagccaccgtgcccaacctcacttgcttcttatccttacactcccacagtaatcttcctcacttctgcgagaagacgacagaaggggagagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370015 - DNA, 378 bp, Homo sapiens
  misc_feature (34)..(34): n is a, c, g, or t
ttcttttcggacctttattttctgtttgctgctnggctagagagagaactcggggggtgtatactgtgggtcgagataaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370016 - DNA, 319 bp, Homo sapiens
gcggccgcctactactactactactgctcgaattcaagcttctaacgatgtacggggacatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370017 - DNA, 498 bp, Homo sapiens
tctctccccttttccttcagagtgaatcatccagactcctcatggataggtcgggtgttaaagttgttttgattatgtaccttttgatcgatccacataaaaagaaatgtgaagtcttcttttactatctttcatttatcaagcagagacctttgttgggaggcggtttgggagaacacatttctaatttgaatgaaatgaaatctattttcagtgaaaacttgttgactttgaaaaaaagcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370018 - DNA, 397 bp, Homo sapiens
gcggccgcctactactactactactgctcgaattcaagcttctaacgatgtacggggacatggtagtttcaaaaaataaatattcaaggccccagttttaaattttcctccaatgtaatccacaaagttgataatacatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370019 - DNA, 247 bp, Homo sapiens
cgcctactactactatacgggtgcgagaagacgacagaagggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370020 - DNA, 850 bp, Homo sapiens
  misc_feature (850)..(850): n is a, c, g, or t
agtaggtctagtacgaggctgggtgggctgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaagaaaaaaaaaaaaaaaaaaaaaaaaaaaaaaaaaaaaaaaaaagaaacaagggggggggggcaaaaaatcccccgggggggcccattggccccttttttgtgtgtacccagggtggcgcccctaaaggggggccgcgaattttaaagcgaaggagcggggggcgcggcgcgttaaaaacaaaacgcgcgcggtgataggggggaaaagaccgtgctctactctggggacacttctttgggggaagaggcacccccttaacttttcgggggggcggggccactcatctggggcacaaacctcacctcatgagaaatttaaagcgactcacaggaacaatctacacaatttcaagctggctctaaggggtggaacccaacggaatatgctgccgctgaaaaaattgggcaacgaaatatgattcagaaaaattacgagctttgtaaaataaagn

SEQ ID NO: 370021 - DNA, 227 bp, Homo sapiens
ttcggctggagagacacgagtgatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370022 - DNA, 298 bp, Homo sapiens
  misc_feature (37)..(37): n is a, c, g, or t
  misc_feature (74)..(75): n is a, c, g, or t
  misc_feature (79)..(80): n is a, c, g, or t
  misc_feature (91)..(91): n is a, c, g, or t
  misc_feature (99)..(99): n is a, c, g, or t
atcccccggggggttaaaaccccccccaaaagggggnaaaaaaaaaagggggggggggggaaaaattttggggnncccnncccaaaaaaanaaattttnccgctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370023 - DNA, 244 bp, Homo sapiens
cggcacgaggctggcctccaaacactgcccgccgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370024 - DNA, 601 bp, Homo sapiens
cttcgataccatattgtgagcggtataataagtattgttacacagtggtagtgcaatcccccgacctgaagcatttttgaaaattcaattggtctgtcctgtggagcaggcagtgatttggttccaaaacttggtatacacatttggagaaaagtactttatatttccagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaagctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370025 - DNA, 435 bp, Homo sapiens
  misc_feature (405)..(406): n is a, c, g, or t
  misc_feature (414)..(415): n is a, c, g, or t
  misc_feature (420)..(420): n is a, c, g, or t
gctgcaggaattcggacgaggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaagaacgggggnnttttttgnnggggngggagaaaaaagagg

SEQ ID NO: 370026 - DNA, 503 bp, Homo sapiens
  misc_feature (34)..(34): n is a, c, g, or t
  misc_feature (402)..(403): n is a, c, g, or t
ttcttttcggacctttattttctgtttgctgctnggctagagagagaactcggggggtgtatactgtgggtcgagataaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatctaaaacatgaatctaaatggctgnnggagaggtcaggtttgggccccccgttactgcagatgaaggcagaagtcattctctcccccacccctcaacttcttcagagatgtggagataggaggctt

SEQ ID NO: 370027 - DNA, 974 bp, Homo sapiens
  misc_feature (655)..(655): n is a, c, g, or t
  misc_feature (675)..(675): n is a, c, g, or t
  misc_feature (681)..(682): n is a, c, g, or t
  misc_feature (784)..(784): n is a, c, g, or t
  misc_feature (860)..(860): n is a, c, g, or t
  misc_feature (907)..(907): n is a, c, g, or t
  misc_feature (971)..(971): n is a, c, g, or t
cttcgataccatattgtgagcggtataataagtattgttacacagtggtagtgcaatcccccgacctgaagcatttttgaaaattcaattggtctgtcctgtggagcaggcagtgatttggttccaaaacttggtatacacatttggagaaaagtactttatatttccagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaagctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaagaaagcggccgctcgaatggnggacgcggccgcgaattcgngcggcnnaggggctgcgagaagacgacagaagggctccacactagcagagaccaaccgaacccccttcgaccttgccgaagggagtccgaactagtctcaggcttcaanatcgaatacgccgcaggcccttcgccctattcttcatagccgaatacacaaacattattataataaacaccctcancactacaatcttcctaggaacaacgtatgacgcactctcccctgaantctacacaacatattttgtcaccaagaccctacttctcctccctattcttatgaattcgcagcntcc

SEQ ID NO: 370028 - DNA, 971 bp, Homo sapiens
  misc_feature (237)..(237): n is a, c, g, or t
  misc_feature (276)..(276): n is a, c, g, or t
  misc_feature (295)..(295): n is a, c, g, or t
  misc_feature (321)..(321): n is a, c, g, or t
  misc_feature (330)..(330): n is a, c, g, or t
  misc_feature (333)..(333): n is a, c, g, or t
  misc_feature (354)..(354): n is a, c, g, or t
  misc_feature (380)..(380): n is a, c, g, or t
  misc_feature (382)..(382): n is a, c, g, or t
  misc_feature (388)..(389): n is a, c, g, or t
  misc_feature (458)..(458): n is a, c, g, or t
  misc_feature (474)..(474): n is a, c, g, or t
gcttgatcttgacagattggcatcctttcgtcgggctgtgagcagtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaacncgagagtagtttcttcttcctcttctttttcttcccccntgttaaagcaagagatggnttagtgcttcattccagccaaagagnctcgaaggnggnttctggaaccttggggggggncgggaggtggttcggggggaatgacnancttcgnncgggaggaaacttcaggggcggggtgggctttgggtgggcagcccgtgggtgggtggggtgggatcatnggtgggcagggggganggcgtcataacgggctttgggtcactcgctgagacacgcccacttgccggcagggtgggctgggaccgctcacaaatgcttttgggcacttacacacaatccagtctcccaactttgtggcccctcgaaagggcggcactctgtcggcggcagacagctctggccccctattgcgggtggacggcccaattacctgtggcaaatacgccaggaaaccaagggtggcaatggggggtccccgccgggcccagtagcttatggcacgtgggcgcacaacttttattcggcacacccacgctttgcagggggagggctaccccgagagtgccggccgctcacggttccccggttgtgacctcggccagccggttggcggctcgttcacagcacctgtctgcgccatccctggttggcacacccggcgttggctctggtacgggttgccgcggagggacccacagtcgcatttgccgcgtgtcgcacgtcgacgttacaac

SEQ ID NO: 370029 - DNA, 292 bp, Homo sapiens
cgcctactactactatacgggtgcgagaagacgacagaagggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaagaaaaaatattaactaaataaaaaaaaaaaagtcgtatcgat

SEQ ID NO: 370030 - DNA, 468 bp, Homo sapiens
  misc_feature (390)..(390): n is a, c, g, or t
taataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccgtttggcagtgaaggaactgaaatgaaccagacactttgcanccaggacactttgcatccagagacactttgcatccagagacactagcatccggagacacttgcatccgagtcagtcct

SEQ ID NO: 370031 - DNA, 198 bp, Homo sapiens
  misc_feature (36)..(37): n is a, c, g, or t
tattcctattatacacgagcacgaagaggatgccanntctgtcaagatcaagaaaaataaggacaacgtgaagtttaaagttcgatgcagcagatacctttacaccctggtcatcactgacaaagagaaggcagagcctgcagtgagcccagatcgcgccactgcactccagcttgggcgacagtgagactccaccac

SEQ ID NO: 370032 - DNA, 210 bp, Homo sapiens
aaagtgtttccttccaggaacttttttttggggggggacagagtctcgctctgtcgcccaggctggaatgcagtggcgcgacctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370033 - DNA, 3017 bp, Homo sapiens
  misc_feature (1211)..(1211): n is a, c, g, or t
  misc_feature (2090)..(2091): n is a, c, g, or t
  misc_feature (2139)..(2139): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370034 - DNA, 2996 bp, Homo sapiens
  misc_feature (1190)..(1190): n is a, c, g, or t
  misc_feature (2069)..(2070): n is a, c, g, or t
  misc_feature (2118)..(2118): n is a, c, g, or t
ggaccgacactttactatatgcccaccacctctcatgccacctcctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370035 - DNA, 3169 bp, Homo sapiens
  misc_feature (1363)..(1363): n is a, c, g, or t
  misc_feature (2242)..(2243): n is a, c, g, or t
  misc_feature (2291)..(2291): n is a, c, g, or t
ggaccgacactttactatatgcccaccacctctcatgccacctcctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcagggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370036 - DNA, 2917 bp, Homo sapiens
  misc_feature (1111)..(1111): n is a, c, g, or t
  misc_feature (1990)..(1991): n is a, c, g, or t
  misc_feature (2039)..(2039): n is a, c, g, or t
taaattcgcggccgcgtcgactgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370037 - DNA, 2942 bp, Homo sapiens
  misc_feature (1136)..(1136): n is a, c, g, or t
  misc_feature (2015)..(2016): n is a, c, g, or t
  misc_feature (2064)..(2064): n is a, c, g, or t
gctgcaggaattcggacgaggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370038 - DNA, 2988 bp, Homo sapiens
  misc_feature (8)..(9): n is a, c, g, or t
  misc_feature (15)..(15): n is a, c, g, or t
  misc_feature (17)..(17): n is a, c, g, or t
  misc_feature (25)..(25): n is a, c, g, or t
  misc_feature (1182)..(1182): n is a, c, g, or t
  misc_feature (2061)..(2062): n is a, c, g, or t
  misc_feature (2110)..(2110): n is a, c, g, or t
catcgacnncccttngnatgggccncgcgccattgtgttgaaacccgcgaattcggccattatggccggggctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370039 - DNA, 583 bp, Homo sapiens
ggaccgacactttactatatgcccaccacctctcatgccacctcctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcagggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370040 - DNA, 958 bp, Homo sapiens
  misc_feature (958)..(958): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaagaaacaagggggggggggcaaaaaatcccccgggggggcccattggccccttttttgtgtgtacccagggtggcgcccctaaaggggggccgcgaattttaaagcgaaggagcggggggcgcggcgcgttaaaaacaaaacgcgcgcggtgataggggggaaaagaccgtgctctactctggggacacttctttgggggaagaggcacccccttaacttttcgggggggcggggccactcatctggggcacaaacctcacctcatgagaaatttaaagcgactcacaggaacaatctacacaatttcaagctggctctaaggggtggaacccaacggaatatgctgccgctgaaaaaattgggcaacgaaatatgattcagaaaaattacgagctttgtaaaataaagn

SEQ ID NO: 370041 - DNA, 512 bp, Homo sapiens
  misc_feature (482)..(483): n is a, c, g, or t
  misc_feature (491)..(492): n is a, c, g, or t
  misc_feature (497)..(497): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaaaaaaacgggggnnttttttgnnggggngggagaaaaaagagg

SEQ ID NO: 370042 - DNA, 605 bp, Homo sapiens
  misc_feature (490)..(490): n is a, c, g, or t
  misc_feature (510)..(510): n is a, c, g, or t
  misc_feature (516)..(517): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaaaaagcggccgctcgaatggnggacgcggccgcgaattcgngcggcnnaggggctgcgagaagacgacagggggcagtacccatgctgatgcctctgccctgaggattctgttttcttccctgatcctgtctcttg

SEQ ID NO: 370043 - DNA, 3510 bp, Homo sapiens
  misc_feature (1704)..(1704): n is a, c, g, or t
  misc_feature (2583)..(2584): n is a, c, g, or t
  misc_feature (2632)..(2632): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccgtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370044 - DNA, 479 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaagaaaaaaaaaaagtcgtatcgatgtcgagcgatcat

SEQ ID NO: 370045 - DNA, 2833 bp, Homo sapiens
  misc_feature (1027)..(1027): n is a, c, g, or t
  misc_feature (1906)..(1907): n is a, c, g, or t
  misc_feature (1955)..(1955): n is a, c, g, or t
cgcctactactactatacgggtgcgagaagacgacagaagggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370046 - DNA, 3008 bp, Homo sapiens
  misc_feature (1202)..(1202): n is a, c, g, or t
  misc_feature (2081)..(2082): n is a, c, g, or t
  misc_feature (2130)..(2130): n is a, c, g, or t
taataaggttgatagaagatattctgtaatgttgtgttcagtgtacccaataaaagtcccaagttggaggaacgggtaatagtgttttctgtttgcacagagggatggtactggaggtgggtgctgtctcctgcatgctgcttactgcttgagtgtatttgcacatggactgtgtcacatctgttttctgtgatacaatttaattcctgattctggtctccggtagctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370047 - DNA, 2820 bp, Homo sapiens
  misc_feature (36)..(37): n is a, c, g, or t
  misc_feature (1014)..(1014): n is a, c, g, or t
  misc_feature (1893)..(1894): n is a, c, g, or t
  misc_feature (1942)..(1942): n is a, c, g, or t
tattcctattatacacgagcacgaagaggatgccanntctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370048 - DNA, 631 bp, Homo sapiens
ggaccgacactttactatatgcccaccacctctcatgccacctcctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcagggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaagaaaaaaaaaaagtcgtatcgatgtcgagcgatcat

SEQ ID NO: 370049 - DNA, 464 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcataaaaaatgctcatatttagataaaaaaagcg

SEQ ID NO: 370050 - DNA, 556 bp, Homo sapiens
  misc_feature (455)..(456): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatctaaaacatgaatctaaatggctgnnggagaggtcaggtttgggccccccgttactgcagatgaaggcagaagtcattctctcccccacccctcaacttcttcagagatgtggagataggaggctt

SEQ ID NO: 370051 - DNA, 473 bp, Homo sapiens
  misc_feature (433)..(433): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcanaaagcatggattacgagaaagaacaacaaagtcgtatcga

SEQ ID NO: 370052 - DNA, 787 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaggggacgggatccaaccgaaaaactttggggcatcaacgggggctaccaagagtataacagtatgcgggtgacaagtcctagccagagcaatcaggcgagagacacagagggcattcaaacagaaagagggctgcatgcagaagttgggacctgtaatcacatcacggggggaggccagggggagagggtagttggagtccaggagttcgagaccaacaggggcaacatagtgagactcggtctctatttttaagcaacgacaacaaaaacaacaaacgaaagggaaaggggggaagtcaaattatctctctgagagggatatgatctgttctaaaaaaca

SEQ ID NO: 370053 - DNA, 806 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaagccaggaaatgaggggtttgggttaaagaaaccctcatgaaacagatttagaatagtctgccataccaatagcagatttaatgatgctgagctttgggctattagccagagaagggagctgagcttgaactcctctagtctacactctcgggcgtcccatcaacccactgtaaatttaggacgtttcttcaacccactggttaaaatttagcttaaaattagtttaagctaccgtcagagaattaccttaggggaacaagccaccataagcagaggtttgcccataaggagacagatttgtaccttttgagcacgttagtgccgcgggggaccctc

SEQ ID NO: 370054 - DNA, 469 bp, Homo sapiens
  misc_feature (451)..(451): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctcgtgccgaatcggcagtnggggggggcccggtaccc

SEQ ID NO: 370055 - DNA, 456 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcagatagaaggcaaaaaaagtcgacg

SEQ ID NO: 370056 - DNA, 924 bp, Homo sapiens
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccgtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatc

SEQ ID NO: 370057 - DNA, 782 bp, Homo sapiens
ggaccgacactttactatatgcccaccacctctcatgccacctcctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcagggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatctccaaattaaatattttctactcatatctttctactctctctttcttactaaaaaaaactatgggggggcctgtccccattgcctcctttaggagtcatttacaatccacggccgcgttttcaactttttgattggaccaaagcccccactgtccctttccaactttgccacctcatgcgaatgcattctaactctatt

SEQ ID NO: 370058 - DNA, 477 bp, Homo sapiens
  misc_feature (399)..(399): n is a, c, g, or t
aactcaggggcgagctgcaactaactcaggagccatctcgatctcactcaggtactgagcagacactttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccgtttggcagtgaaggaactgaaatgaaccagacactttgcanccaggacactttgcatccagagacactttgcatccagagacactagcatccggagacacttgcatccgagtcagtcct

SEQ ID NO: 370059 - DNA, 793 bp, Homo sapiens
gctgcaggaattcggacgaggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcgctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccagggctgggggctccgccgcctctcttgcggctcaccgagctcccggcttccctctctccaggacaggcggttctcagagcacaaagctccagctggagatcacttcccgcaattatccatttgccaaggtctgatgcacaagtgaggctgatc

SEQ ID NO: 370060 - DNA, 804 bp, Homo sapiens
  misc_feature (804)..(804): n is a, c, g, or t
gctgcaggaattcggacgaggctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcaaaaaaaaaaaaaaaaaaaaaaaaaaaaaaaaaaaaaaagaaacaagggggggggggcaaaaaatcccccgggggggcccattggccccttttttgtgtgtacccagggtggcgcccctaaaggggggccgcgaattttaaagcgaaggagcggggggcgcggcgcgttaaaaacaaaacgcgcgcggtgataggggggaaaagaccgtgctctactctggggacacttctttgggggaagaggcacccccttaacttttcgggggggcggggccactcatctggggcacaaacctcacctcatgagaaatttaaagcgactcacaggaacaatctacacaatttcaagctggctctaaggggtggaacccaacggaatatgctgccgctgaaaaaattgggcaacgaaatatgattcagaaaaattacgagctttgtaaaataaagn

SEQ ID NO: 370061 - DNA, 402 bp, Homo sapiens
  misc_feature (8)..(9): n is a, c, g, or t
  misc_feature (15)..(15): n is a, c, g, or t
  misc_feature (17)..(17): n is a, c, g, or t
  misc_feature (25)..(25): n is a, c, g, or t
catcgacnncccttngnatgggccncgcgccattgtgttgaaacccgcgaattcggccattatggccggggctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370062 - DNA, 340 bp, Homo sapiens
ctactactactaaattcgcggcgtcgacggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370063 - DNA, 331 bp, Homo sapiens
taaattcgcggccgcgtcgactgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370064 - DNA, 384 bp, Homo sapiens
agtttctctgccttctctttgtcagtgatgaccagggtgtaaaggtatctgctgcatcgaactttaaacttcacgttgtccttatttttcttgatcttgacagatttggcatcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatc

SEQ ID NO: 370065 - DNA, 312 bp, Homo sapiens
ccttgtaatccaagcagtcgtacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccgttgctgagtgaagaactgaaatgacagacgctgcttgattacagaggatat

SEQ ID NO: 370066 - DNA, 2926 bp, Homo sapiens
  misc_feature (1120)..(1120): n is a, c, g, or t
  misc_feature (1999)..(2000): n is a, c, g, or t
  misc_feature (2048)..(2048): n is a, c, g, or t
ctagtacttacaggatccttagcgtgtcagtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370067 - DNA, 2958 bp, Homo sapiens
  misc_feature (1152)..(1152): n is a, c, g, or t
  misc_feature (2031)..(2032): n is a, c, g, or t
  misc_feature (2080)..(2080): n is a, c, g, or t
acactgcaggcctactgggagaaaagccgaaagctggttaggcagccgtttagcggccaagaagaggggggagctttaggggccgttccagagcccagcgcgccccggcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370068 - DNA, 2970 bp, Homo sapiens
  misc_feature (1164)..(1164): n is a, c, g, or t
  misc_feature (2043)..(2044): n is a, c, g, or t
  misc_feature (2092)..(2092): n is a, c, g, or t
agtttctctgccttctctttgtcagtgatgaccagggtgtaaaggtatctgctgcatcgaactttaaacttcacgttgtccttatttttcttgatcttgacagatttggcatcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtcttttttttttttttttttttcctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccnaggtagtgttttttgtttttttaagatctctaccttttaaaagcgtggcatacagtgtgcttggtattgtgttaggcatttagacgtgctcaggttgtaaggttgaagtgccagtctttgaatattctgtaaggattgtgagggtgtgaggtggttttgagtctggtcacgggtcttgtttcctccgggagagggtgggtacaccagccctcaggcccaggtgcggcactgtgggcggctttcagcctttcccgttctgtaagcattgcagattcccaaggaaaagcgagcctttaccatgtgggttttctttgttcccagcacatcgtccagagtttcatcccagctcctaggagacaggccttgcaggggtgtgtccagccttgtctagagaaggccgcctttcatgcagtgcttcccagccctggcttgtgactcagtcatctggggcacttaggcagttcactgtggtggccagggctgactggagattgcgattgcggtggtctggggcataggtgtgtttccaagctctcaggtgggcctctgctttgctgggcttcagcaagcccttaagtgctgcataccaggtgaatggggaggggggaggtgatgggctacagctgctggtgtgccgactgtcctccaactccctgctgagtctgtgggaggtctgtctgttgtgcttcagctttttgacacctctctgggtcagcaggcctccggggaagcagctagaatggtcgctgtctggctgggtgcaggtgggctgacaggtttggatattccaggccgcattccggtggctgtggagatagccctgagggacagcctttgcagtttgtttcttccagtgccgtgtgcagcctccagccttcnngggctcccttgccccgggttcaaagtcagtcctcggtgaccacccatncctaggagcagcccttcccacctggggggcctctgagggcaggggctgtaaaagcagctaccagaagagtccactttccccagcaactgcagggaccctgactcctgcttgtcctgcagcctgggctcctccctccgctggccaaagtcacgccaagcagtttgcggttaacaggacgggtgggggcctctgcatatgtgcagagtacggagggcccagggacgcgaggctccccgatgggcaacctcccctgcctttgcttttccccagagccccctcctggcctgcgttcggcatcttctcgggtcgtcatcgccctctgcggtgcctgcgctcggggtgagggtttttgtcggcttttgttacatcaccgatgtaacagtgcctggacgtagtaggtgctcaataaatatgttgttgaatgcgcttcagtctccccgaatgcttgtcccttccgggcgctctcatcgctctcctaccttccccgctacacagctcgaaggtcccctcctccgggaagctcaccctgtcccacttgccaggaagaatcaagcaaattttctgagtgagacaccttgtcctcactcaggcgtcctgcaggcggcttcagcgagttgttggggcagatgcgccgggagctcccgagggcagggacggcgtcttatttctctttttaagtccacagggcttgcacaatagatgcccaaaaaatgagagtgaatttagaatgagtgaccgagtggctgaagattgcctccttcctttcccagtctgtcggttacttaccctgtgacaagcccttgggacgggcagtcgcccctctctggcctatgactgctggctgcccccactgacaccttatacccttgcctcgtgcc

SEQ ID NO: 370069 - DNA, 399 bp, Homo sapiens
agtttctctgccttctctttgtcagtgatgaccagggtgtaaaggtatctgctgcatcgaactttaaacttcacgttgtccttatttttcttgatcttgacagatttggcatcgcctcgtcgccatgcctcggaaaattgaggaaatcaaggacttcctgctcacagcccgacgaaaggatgccaaatctgtcaggatcaatataatacagttccaatcagtgtgtctggttcatttcagttccttcactgccaaaccggggggcagggactgcttcagtttctctgccttctctttgtcagtgatgaccagggtgtaaaggtatctgctgcatcgaactttaaactttacgttgtccttatttttcttgatcttggtcgacgggccgcgaatttagta

SEQ ID NO: 370070 - DNA, 1760 bp, Homo sapiens
  misc_feature (1753)..(1753): n is a, c, g, or t
  misc_feature (1760)..(1760): n is a, c, g, or t
caggaggacgggggcgcgcttcccataacattaccctggctgagcgtgaggctccagggctgggcaccgggttgacctcttattcctcgctgagggcatcgttaccgcctgtggctgcaagccgaggcgcgcgggtggaaactgggtcgaggtctgggtagacgtctgagcgatctgcacaaggagtggcgcagtctggaatttgattgaggattcctaacgccctccgcttgatgttctggtgattcccgggggctcggcttcggaggaaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctattggcctcgttggcctcagcggtggagctctgcngccggan

SEQ ID NO: 370071 - DNA, 241 bp, Homo sapiens
ttaataccatggggcatgtgtcttctcctgactccctgcagagctctgactatttttttctttttttactttagttgatcccgctcttgaactctgtagactctgataattgtggatctatggttccatcttttgctgatattttgtatgtggcaaatgatgaagaagccagttatctcagatttcggtaattttatatgcttatcttgggaagtgggctataaactgaattcttgcatgt

SEQ ID NO: 370072 - DNA, 1550 bp, Homo sapiens
  misc_feature (1543)..(1543): n is a, c, g, or t
  misc_feature (1550)..(1550): n is a, c, g, or t
tgggatgcggaagtagcagtcctgtcatgcggaagtagcagtccggtcctagggactagcaggcaccaagaaactgataatgttcctttgaattggcttctgtatttgcttcatcaatgtctctcatactgaatatcttaagagagatgctggaatattttggcgttcctgtagaacaggttttgctgatttgggaaaataaagactatggatcaactaggagtattgttcgtattattgggaaaatgcttccactggaaccttgtcgaagacctaattttgagttgatcccgctcttgaactctgtagactctgataattgtggatctatggttccatcttttgctgatattttgtatgtggcaaatgatgaagaagccagttatctcagatttcgaaatagtatatggaaaaatgaagaagagaaagtggaaatttttcatcctttgcgactagttcgggatccactgtcacctgctgtaagacagaaagaaactgtgaaaaatgacctgcctgtaaatgaagctgcaattagaaaaatagctgcccttgaaaatgagctgacttttcttcgctctcagattgcagcaattgtggaaatgcaggaactgaaaaatagtacaaattctagttcctttggcttgagtgacgagcgcattagtttgggtcagctgtcatcatcgcgggctgcccatctgagtgtggacccagatcagcttccaggttcagtgctttctcctcctcctcctccaccacttcctcctcagttttcatctctccagccaccgtgttttcctcccgtacaaccaggatctaataatatttgtgactcagataatccagcaactgaaatgagcaaacagaacccggctgctaataagaccaattatagtcatcattcaaaaagccagagaaataaagatattccaaacatgttggacgttctaaaggatatgaataaggttaagcttcgtgcaattgagcggtcacctggcggtagacccattcataagaggaaaagacagaattcacattgggatccagtttctttaatatctcatgcacttaaacagaaatttgcatttcaagaagatgattcttttgagaaagagaatagatcttgggaatcttccccattttctagtccagaaacttcaaggtttggacatcacatttcacagtcagaaggacagcgaactaaagaagaaatggtcaacacaaaagctgttgaccaaggtatcagcaacacaagccttctaaactcaaggatttaaactcaacttaaggttgagctttaaacttccaaaacttcttcctggatgataaattattcttagaaactgatttggactgttaaaggctaaaagtagatgtatttaaagactcttcttgacacattttgcctacacttgctatgtaaatatgtatgcctgtcatttttgtttcctttgttcctttttacgtttatactctgttcttctgtacatagagcttaaaataaacattctattggcctcgttggcctcagcggtggagctctgcngccggan

SEQ ID NO: 370073 - DNA, 703 bp, Homo sapiens
tgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgttcagaaacttagtctggttgcagtaagtaattctgttccacaggatatctgctgtatggcagctgatggcagattagtctttgctgcttatggaaatgttttctctgcatttgcccgtaataaagagatagtacatacctttaagggtcataaggcagaaatccatttcttgcaaccctttggagaccacattatctctgttgatactgatggcattcttattatttggcacatatattcagaagaagaatacctgcagttgacttttgataaatcagtatttaaaatttctgcaattttgcatccaagtacctacttgaataaaatacttctgggcagtgaacaaggaagcctgcagttgtggaatgtaaaatccaataaacttctatatacatttccaggatggaaagttggagtgacagctcttcagcagg

SEQ ID NO: 370074 - DNA, 399 bp, Homo sapiens
tgtctgcagctctggcagaggactgttccactagacacgctgaagggactgggtacgtgttttccttcaggaccagagctgagaggagctgggatcgcggcggcaatggaacgggcctcagaaaggcgcacggccagcgcgctttttgcggggttccgggccttgggacttttcagcaacgacattccacacgtggtgcggttcagcgcgctcaagcgccggttctatgtaacaacctgcgtgggcaagagtttccacacctatgacgtgagtgacttcttttgttagcttcccaggcccatttaccacgggcttcccttctttaacccctccctgtcctattaatatttcgccatccggtcacgtccacgtgctgatttggcacttgcagtcctcctg

SEQ ID NO: 370075 - DNA, 472 bp, Homo sapiens
ctgcaagggccactcctgccagatttgcagatttagccaggtcggcagggctgcgggtgggccaaagtcatgggcctcattccaagccgtggccgctgcactgaccaccctgggtgtgaaggccactcgcatatagaggtgacaggcgacccctctgttgcctttgctctgcctccctggagggctggggagagcaggtaagtggggccatgggggcacttggcatggtgcatggagcacaggggctggggtcgggtccttccaggccacctgccgagagctaaaacatgtgctttgaacgactgccagcaggatgcggtagcacgcacctgcaatcccagcgctttgggaggccaaagccggaggatcacttgaggccaggagtttgaaaccagcctgggcaacatagcaagaccacacgcctacaagaaaaaataaataaaatgtctggaataaggaattcaaaaaaaaa

SEQ ID NO: 370076 - DNA, 655 bp, Homo sapiens
  misc_feature (552)..(552): n is a, c, g, or t
ctggggccctgggcccctcgtaggatagacagagcctgtcctaaccttccggaagtgcatgctggggaggccccttgcctgctgaccttctgtgctcaggacgactaatcggccacatgaccaccactctgtcccatgggattcctagagaagtctcactaagagcccagcacactcacatcacaactaacctcctgggatctgctcacacctccggcagtaacctcgcccactcagagatgtcagtgggaccccttgcttctttgtttcagaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctntcccttgccccggcgcgcaccaaacccagaagacccataaaataaacgtgaaaagacaaacacgaggaaaaacgaaaacaaagttaaagagaaaaaaatgaga

SEQ ID NO: 370077 - DNA, 257 bp, Homo sapiens
cgtaagcatagctgaagtctggcctcagcctggtcccatggggagctctagtgggttcatagcgccacagagctcatcctgcccgtcttgagagctttcacttctgcaacttcatttcctcctccttcccactatctccccctccctccaagaaaaaaaaaatgttctcgtgttgagatgatttagagctgtctctttatgggtttcccagaagcagggtctgagatggggtatttgcacacacagcggcttatgga

SEQ ID NO: 370078 - DNA, 282 bp, Homo sapiens
tgttttgttttgttttgcttgagaccaggctattgtgcagtggtgtaatcacagctcactgcagcctcaacctcctgggctcaagcaatccccccacctcagcctcccaagtagctgggacaacaggcacacgccaccacgcctggcttattttttcttttataaagacagggtctgattatgttgcccaggctaatctcaaactcctgggcaacatagcaagaccacacgcctacaagaaaaaataaataaaatgtctggaataaggaattcaaaaaaaaa

SEQ ID NO: 370079 - DNA, 6221 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctaacaagagccccaagacccgagagcctgctggaggagcgggccggctcttgacgacctccagggtctccccgagccccagcacgcgaaacctggccctcggaagctggcggagcgcggccctcaggactcgggggacagggcggccagcccggccgggccgcgcaagagccctcaggaggcggccgccgcgcccggcacgagagagccctgcccagccgcccaggagccggccccgagtgaggacagaaaccccttccccgttaagctccggtccacctccctctcgctcaaatacagggatggcgcctctcaggaggtga

SEQ ID NO: 370080 - DNA, 7740 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370081 - DNA, 7716 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgctgctcaatgctagatttctcatttgacggctctgaggagttcgatattaacgcttttgaggacatcattgctttctatgaaagcaagaagaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370082 - DNA, 8013 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgctgctcaatgctagatttctcatttgacggctctgaggagttcgatattaacgcttttgaggacatcattgctttctatgaaagcaagaagtaagtgcagaaagggcctttgatcccgaggccacattgagcacagtgtctttcccccagctgcatgttttggcttcagtggcctggggatggtcccaatggcgctgggaaccccgaggtggcaggcctgcttctaactccatcttctttctgtcactgcgccccctccacccctcccctcagcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370083 - DNA, 8003 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtgagtaggctgcacatagatgagagtccgagcaggcgaacattggcaggagcatgcacgtgtgtgtcagtgtcaatgtgcgcatgggcccgtctgcacgcgtatgtgtgcgtggacacgtgtgagtgtgtttttcccccggcatatacggagccgtagtcttgaataagtcacccctgagatcccatgggtcgtcatccaccagtggctggggagggctgccttcccctttccctgcccagcgccttcctctggcctcacaggtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370084 - DNA, 6150 bp, Homo sapiens
tggaggcctgagctgactttaagggtcaacagccatggaaatgtgggcttctcccgccccaagaagcagattttgccgtcctctcgccatcctgaacctgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370085 - DNA, 6076 bp, Homo sapiens
tgttttgttttgttttgcttgagaccaggctattgtgcagtggtgtaatcacagctcactgcagcctcaacctcctgggctcaagcaatccccccacctcagcctcccaagtagctgggacaacaggcacacgccaccacgcctggcttattttttcttttataaagacagggtctgattatgttgcccaggctaatctcaaactcctggcctcaagccatcttcccacctcagcctcccaaagtgatgggactacaggcatgagccaccacacccagtcctcttttttttttttcttgcctccgttaccccaaagacaaagtgacttctgacctgcggtagcagaagcagcatccatctccccagggcctggccacagggctgcaggtcccgcccaaggagcatgttaagtttatacagattctccctttcagctgctcaatgctagatttctcatttgacggctctgaggagttcgatattaacgcttttgaggacatcattgctttctatgaaagcaagaagtaagtgcagaaagggcctttgatcccgaggccacattgagcacagtgtctttcccccagctgcatgttttggcttcagtggcctggggatggtcccaatggcgctgggaaccccgaggtggcaggcctgcttctaactccatcttctttctgtcactgcgccccctccacccctcccctcagcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370086 - DNA, 5604 bp, Homo sapiens
gtccaatttgcctcaaagccctgccccgctccagggcttggggaggctggcccagtccccatttctggcaaaagagagaggggcagcattgagcacagtgtctttcccccagctgcatgttttggcttcagtggcctggggatggtcccaatggcgctgggaaccccgaggtggcaggcctgcttctaactccatcttctttctgtcactgcgccccctccacccctcccctcagcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370087 - DNA, 7336 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370088 - DNA, 6331 bp, Homo sapiens
  misc_feature (6228)..(6228): n is a, c, g, or t
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctntcccttgccccggcgcgcaccaaacccagaagacccataaaataaacgtgaaaagacaaacacgaggaaaaacgaaaacaaagttaaagagaaaaaaatgaga

SEQ ID NO: 370089 - DNA, 2064 bp, Homo sapiens
ctggggccctgggcccctcgtaggatagacagagcctgtcctaaccttccggaagtgcatgctggggaggccccttgcctgctgaccttctgtgctcaggacgactaatcggccacatgaccaccactctgtcccatgggattcctagagaagtctcactaagagcccagcacactcacatcacaactaacctcctgggatctgctcacacctccggcagtaacctcgcccactcagagatgtcagtgggaccccttgcttctttgtttcagaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370090 - DNA, 5211 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtgagtaggctgcacatagatgagagtccgagcaggcgagattaacgatgaggacaaacagaagattctggacaagtgtaatgaaattatcaactggcttgataagaatcagactgccgagaaggaagaatttgaacatcaacagaaagagctggagaaagtttgcaagcgcatcacccgt

SEQ ID NO: 370091 - DNA, 1413 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacagagcaagacactgtttccaaa

SEQ ID NO: 370092 - DNA, 1172 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtgagcggggaagctggtcggtctgtgggagggggcatttgtttggaaaatgcgggtttcaggccaagctcggtggcccacatctataatcccaatgctttggaaggctgagggaggaggattgcttgagcccaggagttcaagatcagcctgggcaacatagcaagatcttttctctac

SEQ ID NO: 370093 - DNA, 388 bp, Homo sapiens
aagaaggacgtggaagaggcagtctcggtgagtgcccccatttgcttcctcaagcccggccaggggaggccacatcctcactaccaatatccttggtgggcgacctggaacatccggagccgaggcatctgcaatcaagaggctgtttccccacaaggacaggcccaggaaacaggacaggctacgaaattcaacaggcccagggcagaatgaaaacataaggccccttattcaaaaacgacagattctggcatgtacctgtggtcccagctactcaggaggctgaggcagaaggattgcttgagcccaggaggtcaaggctgcagtgagctgtggtggcgccactgcactccaacctgggcaacagagcaagaccccatctccaaaa

SEQ ID NO: 370094 - DNA, 512 bp, Homo sapiens
aacctactggactccaagtccctgaaactcatcatcagcatgactctgcacgaccgcaccaccaagtccctactgcacctgcacaagaagaaaaagccaccaagcatcagcgcccagttccaggtaggtggagcaggagaggcagaaggtggcggtcagctcagcctcaggcttgtgtagcttcacccgacaccgagcacagcccgtctctagtaaaaatacaaaaattggccgggcgcggtggctcaagcctgtaatcccagcactttgggaggccgaggcgggcggatcacgaggtcaggagattgagaccatccttgctaacacggtgaaaccccacctctactaaaaatacaaaaattagccgggcgtagtggcgggtgcctgtagtcccagctactcgggaggctgaggcaagagaatggcatgaacccgggaggcggagcttgcagtgagccgagatggcgccactgcactccagcctgggcgacagagcaagactccatctcaaa

SEQ ID NO: 370095 - DNA, 563 bp, Homo sapiens
agaccgtgcgcatccggaggtcagggtacagcgccaagtacacgttacaggatttcaccgagcagttccaggtgctcctacccaaggatgcccagccctgcagggaggtcatctccaccctcctggagaaaatgaagatagacaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaaggtaaaaaaaaaaacacaccccgcgcgacacgttccaagatatcttgcttctctgcccgtcttgagagctttcacttctgcaacttcatttcctcctccttcccactatctccccctccctccaagaaaaaaaaaatgttctcgtgttgagatgatttagagctgtctctttatgggtttcccagaagcagggtctgagatggggtatttgcacacacagcggcttatgga

SEQ ID NO: 370096 - DNA, 7620 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370097 - DNA, 7626 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccggaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370098 - DNA, 6600 bp, Homo sapiens
cgcttatgttgcatttttatttgagattatgaatattattagtaatatttgagatgttttgtttgtgtttagtctttgtatttttggttttatgttgtttttttttttggagggtgggcagcactcgctttattgtccagcattccacatggatagacgcaggacagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370099 - DNA, 6475 bp, Homo sapiens
ctgtaatcccaacactttgggaggccgaggcgggtggatcacctgaggtcaagagttcgagaccagcctggccaacatggtgaaaccccatctctactaaaaatacaaaatttagctgggcatggtggcaggtgcctgtaatcccagctatcaggaggctgaggcagaaggattgcttgagcccaggaggtcaaggctgcagtgagctgtggtggcgccactgcactccaacctgggcaacagagcaagaccccatctccaaaaaaaattatggattccatgctggtaatggcaaagtgttctgccgagcaacagggactggggacctaacaggtcacagcctgtagagccaacccctctcatgaaggctggctccctcggggtgcacctgcgggcagtgaccattttctctgtctctcccagtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370100 - DNA, 5534 bp, Homo sapiens
gcagaggagagggacggccaggttcagtagcactggcttcctctctaacccagaggaagaggaaatggggcagccactcaggctgtgaaagaggctgtcatcagccctcccggaaccagcgctgtgtgcaaggtgcaaacccacctcattccactgggcccacatcaatagtgtggtcctgagaccaaacctaagagctgctgcccgggcactcgctgcggggacgctgttctgccctggcttcggggacacctgtgatgcctccccgtgcccgtgtgggctgtgggagggcaggccggaccccatgtgtctgtcctagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370101 - DNA, 5354 bp, Homo sapiens
tccactagtgtaggcccgccaggcgtggcttgctgaactaacccaaatcccgacactgtgttccttttgttcacaaaaccatttttaatattttgacaggaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370102 - DNA, 7572 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370103 - DNA, 5416 bp, Homo sapiens
cctgcgacccgatgcccaggacacgatgcccgtggcacccagcgatcagtgtacgggtcccttactgcaaaaacgcccccactatccccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcagcctgcagcagaaaccacggacggagagcgaagtgcgaaaaagccagctgtccagaagaagaagccaggcgacgcatcctccctcccagacgcagggctgtccccgggctctcaggtcgactctaaatccacgtttaagaggctttttctgcataaaaccaaggataaaaaatacagcctggagggcgcagaggagctggagaatgcagtgtccgggcacgtggtgctggaagccaccaccatgaagaagggcctggaagccccctccggacagcagcatcgccacgctgcaggtgagaagcgcaccaaggaaccaggaggcaaagggaagaagaaccgaaatgtcaagattgggaagatcacagtgtcagagaagtggcgggaatcggtgttccgccagatcaccaacgccaatgagctcaagtacctggacgagttcctgctcaacaagataaatgacctccgttcccagaagacgcccattgagagcttgtttatcgaagccaccgagaagttcaggagcaacatcaaaacgatgtactctgtcccgaacgggaagatccacgtgggctacaaggatctgatggagaactaccagatcgtcgtcagcaacctggccactgagcgtggccagaaggacaccaacctggtcctcaacctcttccagtcactgctagatgagttcacccgtggctacaccaagaacgacttcgagccagtgaagcagagcaaagctcagaagaagaagcggaagcaggagcgtgctgtccaggagcacaacgggcacgtgttcgccagctaccaggttagcatcccgcagtcgtgcgagcagtgcctctcctatatctggctcatggacaaggccctgctctgcagcgtgtgcaagatgacctgccacaagaagtgcgtgcacaagattcagagccactgctcctacacctacgggaggaagggcgagccaggcgctgagcctggccacttcggcgtgtgcgtagacagcctgaccagcgacaaggcctcggtgcccatcgtgctggagaagctcctggaacacgtggagatgcacggcctgtacaccgagggcctctaccgcaagtcgggtgctgccaaccgcactcgggagctccggcaggcgctgcagacagaccccgcagcagtcaagctggagaacttccccatccacgccatcacaggggtgctgaagcagtggctgcgggagctgcccgagcccctcatgaccttcgcacagtacggcgacttcctccgagccgtcgagctgccggagaagcaggagcagctggctgccatctatgccgtcctggagcaccttccagaagccaaccacaactccctggagagactcatcttccaccttgtcaaggtggccctgctcgaggatgtcaaccgcatgtcacctggggcgctggccattatcttcgcaccctgcctcctgcgctgccctgacaactcggacccgctgaccagcatgaaggacgtcctcaagatcaccacgtgcgtggagatgctgatcaaggagcagatgaggaaatacaaagtgaagatggaggagatcagccaactggaggctgcagagagtatcgccttccgcaggctttcgctcctgcgacaaaatgctccatggcctctcaaactggggttttcgtctccctatgagggggtcctgaacaagagccccaagacccgggacatccaggaggaggagctggaggtgctgctggaggaggaggcagccggcggcgatgaggaccgggaaaaggagattctcattgaacggatccagtccatcaaggaggagaaggaggacatcacctaccggctgccggagctggacccaaggggctcggacgaggagaacctggactcggagacgtcggccagcaccgagagcctgctggaggagcgggccgggcggggggcctcggaaggtcagtattaaggtagcgtctgcttttctccttcccgtccatcccagcaggccccagggcgagggtcctccggctgccggccctgaagctgcagtaaccctgccatctgtctctcaaaagggccccctgcgcctgctctcccttgccccggcgcgcccaccccgagccccctccccaccgtggccgcccctccacgacgaaggccgtcgtccttcgtaacggtcagagtgaagaccccccggcggacccccatcatgcccacggccaacatcaagctcccaccaggcctgccctcccacctgcctcgctgggcaccgggtgcccgggaggcggctgccccagtgcggcgccgggagccacctgcccgccgcccggaccagatacattccgtgtacatcacgcccggggcagacctgccagtgcagggcgccctggagcccctagaagaggatggccagccacctggggccaagcggaggtactcggatcccccaacgtactgcctgccccccgcctcgggccagaccaatggctgagagccacagctgacaaagtctgcatgtccgaggacggcccctgcactggagctgggcgccagagctgcagagctagtgttcggccctcagagaaggatccagaatcaaaagctcaagagtgacgtgaggtgggcaccggccccaagtgcagagtcaaggcagggagaggccggctggagccaggccccctcgcacgcagcccccaaatcatggacgcacctgtggggagcaccacatctccacctgcggcctcacatctccccactcccctttttgtacgtttaactgtttctttgtacgtggtttacgtaactttaaactgtaacagccttaatggaagaccaaatggttttttatatgtgtatgtacaaagttttctattaacgctgcccgtctcccttataacctggacgtgagctgtcagagcagaagccactaggccactgcgcgtctgaggctcagaccctgctgtggttggcttggggtggccaatgggctgggaccctccatgagagttttggacacttgggtcacctgacccgtgcctctctgacacatgtctccggggggcagccacctggccaatgtgcatttttgcacgtgctggaaccttccatgggggtctgggctattggctggagccaggacatgagtcaggggcaccatggacctcacgtgccagggagacttgaatgtggctgtcactcttccggacgccaagggctgcaggaggctgcttttggcactacccaccccgtgtgacagaataggagccagcgactcaggactgctcacgggtcaggagggcaacgcctgaagtcagacctccctataggtcaacagggacaacctggggatctctggagcagggccctcctctctcaggcttggcccactcccccagacacctggacacgtggccacaaatctgggacaaggggcccccgcacagcatgaaataaaaagtgcctgagaagtgtgtgcatgggacgcc

SEQ ID NO: 370104 - DNA, 4293 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggcttttggaaatgccaagacagcccacaacaacaactccagccggtttgggaaattcatccaagtcagctacctagagagtggcatcgtgagaggagctgtcgtcgagaaatatctgcttgaaaagtctcgcctggtgtctcaggagaaggatgagaggaactaccatgtgttttattatttgttacttggggtcagcgaggaagagcgccaagaatttcagctcaagcagcctgaagattatttctacctcaaccagcataacttgaagattgaagatggggaggacctgaagcatgactttgagaggctcaagcaggccatggagatggtgggcttcctccccgccaccaagaagcagatttttgccgtcctctcggccatcctgtacctgggcaacgtcacttataagaagagagctacaggccgagaggaagggttggaggtcgggccacccgaggtgctggacaccctgtcgcagcttctgaaggtgaagcgagaaatcttggtggaggttctgaccaaaagaaaaacggtgaccgtcaacgacaagcttatccttccctacagcctcagcgaggccatcactgcccgcgactccatggccaagtctctgtacagcgccctgttcgactggattgtgctgcggatcaaccacgcactcctcaacaagaaggacgtggaagaggcagtctcgtgcctgtccattggggtcctggacatcttcgggtttgaagacttcgagaggaacagctttgagcagttctgcatcaactacgccaatgagcagctgcagtattacttcaaccagcacatcttcaagctggagcaggaggaatatcagggcgaggggatcacgtggcacaacatcggctacacagacaatgtcggctgcatccatctcatcagcaagaaacccacgggcctcttctacctgctggacgaggagagcaacttcccccacgccacgagccagaccctgctggccaagttcaaacagcaacatgaggacaataagtacttcctgggcaccccggtcatggagccagctttcatcatccagcacttcgcagggaaggtgaaatatcagatcaaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtatgagcagccctggtgcccaaagtcacccagaagagctgccaagaggagccagcaccccttcggaaaaactttaccgcgatttgcataaccaaatgatcaagagcatcaaaggattgccctggcagggcgaggacccccgtagccttctccagtccctcagtcggctccagaaaccccgcgccttcatcctgaaaagtaaaggtatcaaacaaaagcagatcattccaaagaacctactggactccaagtccctgaaactcatcatcagcatgactctgcacgaccgcaccaccaagtccctactgcacctgcacaagaagaaaaagccaccaagcatcagcgcccagttccagacatcccttaacaagctcttggaggcactggggaaggcggagcccttctttatccgctgcatccgttccaatgctgaaaagaaagagctgtgctttgacgacgagctggtcctgcagcagctgcgctacaccggcatgctggagaccgtgcgcatccggaggtcagggtacagcgccaagtacacgttccaggatttcaccgagcagttccaggtgctcctgcccaaggatgcccagccctgcagggaggtcatctccaccctcctggagaaaatgaagatagacaagaggaactaccagatcgggaagaccaaggtcttcctgaaggagacggagcggcaagccctgcaggagacgctgcaccgggaggtggtgcggaaaatcctgctgctgcagagctggttccggatggtgctggagcgtcggcacttcctgcagatgaagcgggccgccgtcaccatccaggcctgctggcggtcctaccgggtccggagggcgctggagaggacgcaggctgccgtgtacctccaggcctcatggaggggctactggcagcggaagctctaccggcaccagaaacagagcatcatccgcctgcagagcctgtgtcgggggcacctgcagcgcaagagcttcagccagatgatctcggagaagcagaaggcagaagagaaggagagggaagccctggaagccgcaagagcaggtgctgaggagggcggacagggtcaggcggctggagggcagcaggtagctgagcaggggccggagccagcggaggatggcgggcacctggcatcggagcctgaggtgcagccaagtgacaggtcccccctagagcactcctcacctgagaaggaggccccaagcccagagaagactctcccaccccagaaaaccgtggcggctgaaagtcacgagaaagtccccagcagccgggagaagcgtgagtcgcgtcggcaaagagggctggagcacgtcaagttccagaacaaacacatccagtcctgcaaggaggagagtgccctcagagaaccttccagaagggtcacccaggagcaaggggtgagtctcctggaagacaaaaaggagagcagagaagatgaaacccttctagtcgtagagacggaggctgagaacacatctcaaaagcagcccacagagcaaccccaggccatggcagttggcaaggtctctgaagaaactgagaagacgctgcccagtgggagccccaggcctggccagttggagcggccgaccagcctggccctggacagcagggtcagcccaccggcccctggcagcgcccccgagacccccgaggacaagagcaaaccatgtggcagcccaagggttcaggaaaagcccgacagccccggaggctccacgcagatccagcggtacctggacgccgagcggctggccagcgccgtggaactgtggcggggcaagaagctggtggccgccgccagccctagtgccatgctcagccagtccctggacctcagcgacagacaccgggccacaggggccgccctcacgcccacagaggagaggcgcacctccttctccacgagcgacgtctccaagctcctcccgtccctggccaaggctcaggtaacaacaacacggcaaaaccccgtct

SEQ ID NO: 370105 - DNA, 1525 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtactgcgaagccaactggtcaggatgcaactgcctcttggaaagagagtttgttactcacagttcccgaaagaagaggatgcaatgccatggaaggccacagggggaagcactgggactcatcaggaggctgagggagagagggaaaaagggagcggggagaggcaggaaactttattgtgattttcatgcatcagaatgtgctaggcagagtaagctggcttaggattggcttgtttgaattatttcaatgggctctggggcataggggctgccccttgttgtcaggtgccagggcctggggtgatgagggcaggggatagtgggctggagtgtgagagtcccagagaggaggtggctggggtgtaggctctggactggttggtttgcatatggaaggcaagtcccaaaccatctctaggaactggctagaatcaatctaggaattgggaagggccgtctccctggggtcagccaggccccagatgtcagagcatcagaaatacagaaaataagtcactgggcgcggtggc

SEQ ID NO: 370106 - DNA, 1234 bp, Homo sapiens
cggggcggagcggctcgagcagcggcgggctggcaggcggtcgtccggccggggacccggcccgggaccggcggcgcgcggcggccgaggccagctccaggacacgcgcgccccgagcctgggaggcatgctgaagccaggcggccggcaggatgagtgtgaaagaggcaggcagctcgggccgccgggagcaggcggcctaccacctgcacatctacccccagctgtccaccaccgagagccaggcctcgtgccgcgtgactgccaccaaggacagcaccacctcggacgtcatcaaggacgccattgccagcctgcggctggacggcaccaaatgttatgtgctggtggaggtcaaagagtcgggaggcgaggaatgggtgctggacgccaacgactcgcctgtgcaccgggtgctgctatggccccggcgggcacaggacgagcaccctcaggaggatggctactacttcctgctgcaggagcgcaacgcagatggaaccatcaagtacgtgcatatgcagctggtggcgcaggccacagccacccggcgcctagtggagcgtggcctcctgccacggcagcaggcggactttgatgacctgtgtaacctccccgagctaaccgagggcaacctcctgaagaacctcaagcaccgcttcctgcaacaaaagatctacacgtacgcggggagcatcctggtggccatcaacccctttaagttcctgcccatctacaaccccaagtacgtgaagatgtatgagaaccagcagctgggcaagctggagccacacgtcttcgcgctggccgacgtggcctactacaccatgctcaggaagcgcgtgaaccagtgcatcgtgatctcgggtgagagcggctccggcaagacccagagcaccaacttcctcatccactgcctcaccgccctcagccagaagggctacgccagcggcgtcgagaggaccatcctgggtgctggccctgtgctggaggtactgcgaagccaactggtcaggatgcaactgcctcttggaaagagagtttgttactcacagttcccgaaagaagaggatgcaatgccatggaaggccacagggggaagcactgggactcatcaggaggctgagggagagagggaaaaagggagcggggagaggcaggaaactttattgtgattttcatgcatcagaatgtgtgggattataggcgtgaaccactgtacccagctccgctt

SEQ ID NO: 370107 - DNA, 400 bp, Homo sapiens
accgtcagcccttcctgcgccagcccggggtctttggtaggcgccggtgagtgactatccccgagtgaccgcccacatccatcccccaccaggacttccgggagaagaacatggactacatgcggccagacatcgtggccctgctgcggggcagtgacagctcctacgtgcgggagctcatcggcatggaccccgtggccgtgttccgctgggccgtgctccgggctgctatccgggccatggcagtgcttcgggaggccggacgcctgcgggccgagagggccgaaaaggctgcaggtgggagctggggcgtgaacccacaaaagcgtcactgtcgagaggggggcacatcctgagttcatcttaaagtgaacacttcagtggcatttagtacattcat

SEQ ID NO: 370108 - DNA, 5189 bp, Homo sapiens
  misc_feature (1496)..(1496): n is a, c, g, or t
  misc_feature (3417)..(3417): n is a, c, g, or t
tgttgggattacaggcgtgagctaccacgcccggccctaggctccacaactctaagaagctttgtgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactnggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgngtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggatttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaaaaacacacacacaggcatgggctcacctcttctgctggaagctcctctgtcctccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgtgaaaaaaaaaaaa

SEQ ID NO: 370109 - DNA, 5135 bp, Homo sapiens
  misc_feature (1496)..(1496): n is a, c, g, or t
  misc_feature (3417)..(3417): n is a, c, g, or t
tgttgggattacaggcgtgagctaccacgcccggccctaggctccacaactctaagaagctttgtgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactnggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgngtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggatttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgtgaaaaaaaaaaaa

SEQ ID NO: 370110 - DNA, 403 bp, Homo sapiens
ttccaagtttaaggttttcttaattagaaggcctgagagaagatgagtgaggacaaatccgagtttccctgtgtgtggctggccatggttggcggtcgcagcatcacagcgttggccggctgctgcttagctttattttacttgtgatttttctttgttatgcaccgaacagattcccctctctggtattcagtggggagcatatagccggaggatagcaattagctatagctaggcctgctcctctttgcacagctcaagatgacgtgtacaattactttggcacctcaccagctctttcagaccttttccatgcatgatgggaagacaggtccattctctgagagtccctcactccctccccctcccaaattcccccttacctggatgaaatcctgatgta

SEQ ID NO: 370111 - DNA, 2623 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcc

SEQ ID NO: 370112 - DNA, 2602 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcc

SEQ ID NO: 370113 - DNA, 2349 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaaatcacagtttatccctgcaccttcatagattatgttgctcgtcttagagaccaccaggcagcgaatggagtcaagcccttgcgctctccgagagtcctgccctgactacaggactagtttctcccattctttccttctccaggataaagttcctcattcctgtctttta

SEQ ID NO: 370114 - DNA, 1391 bp, Homo sapiens
cttgggtgtcgggaccacatcctcttttctttgataagaagccacctggctcttgcttggatggtgggacccagccctggctgggtaaaatgtgtccagcaggtttctcctgtctcacggttcctctttctgacaggtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcc

SEQ ID NO: 370115 - DNA, 2658 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgctcactggaccccaaactggacatcctggaggcagcgaggcccttcctcctcacgggcccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaagagggaggctatcattcatgtggagggggcagtgccgggaatttctcagaatgttgtggggggggcatatctttgttcaaaaaaaaaatgggttttttgggggaaaggtaagggggtaggtcgaccttgaagggatgggcaagggaac

SEQ ID NO: 370116 - DNA, 2565 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaagcttgagagcaactttgcctccattgtgtttgccatcatggtgttggaggggcttggccgccagtgtgccccccgtgatggggcagtggcctctgtgggcccttgtcaagagctggaggccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcc

SEQ ID NO: 370117 - DNA, 1857 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccactcccaagagcctctcctatggcagctgggacgttttaaaattgggacaccaatttcaaatgtaaccctccagtggtggaaggcacaccatggcttcctctgcttggtttgagggtctgttcaaaagctttgggccaattagggagtaaaaggagggaaggggcctatccattccattgtggaagctgggccaggtgccagggacactctccttcagggaaaatgttatgtggaggaggacgaataaatttattttgttttcc

SEQ ID NO: 370118 - DNA, 2634 bp, Homo sapiens
gccccgccctcccggcccccgcctgcgcccgcgccctgggctggtgcccgccaccccagcgatctcatactggcccctgggcgcacggtgaccctgcggctgcccggcccctgcctccgcccgcgcggccccctcgctcaggtcgcgggcgcccggggcctggcttcgcgtgggtcctggctcctcccgttccgcagttggtgccgtctgacagccccttccgcgcggcgcggcgcggcgcggcgggtgtcgggcggggcgcgggcctccggcctgaggcccggcgaggtgctggagggagcggggcgcggatccggcccagatgggcagctccgtccgcggggtcagggccgggcttcggcttcaccgcagcctcgcctgagcgggcgcctctgaagtggagggcgggccgcctgggccgcgggcctcgggaggatggtggcgccctggcgcgtctccgtcagggtttgcctgtcgcacctgaggtgcttcgagctcagacagggactcagcctcctgaggccctccgagtgccctcgcgatgccaggctctgctggcttctgctgggcactttgcccaaggtcgtctccctgtgcggggacgtgggtgagggggcccctgacgttctgagtcggcgaagggtccgctgcagcggggcggctggcgcggggcccgcggagagcctcccccgagcgggacctctgggcggcgtcttcctgcatctccgcctctggcttcgcgccggcgctctgttggtgaaattcttccccctcctactcctctaccccctcacctacctggctcccagcgtctccaccctctggctccacctgcttctgaaagccaccgagacctcaggcccaacctacatcaaactgggccagtgggccagcacccggcgcgatctgttttcggaggctttctgtgcccaattttccaagctgcatgtccgagtgacgccccacccgtggactcacactgagcgcttccttcggcaggcttttggggatgactgggggagcatcctctcttttgagaaccgggaacctgtgggctcaggctgcgtggcccaggtgtacaaagcatacgccaacactgccttcctggagactgacagcgtccagagacttggcagggcctcctgtctgccgcccttctcacatactggggcagtcggtgggctgagagagctctttggataccttggaaatggccggaaacctccagaaaatctcgcagaccagtcgtttctagaaaggctgctcctccctaaagctgacctggttggatcaaatgcaggggtgtctcgggctcaggtccctggccaccaacctgaggccaccaacctcatctccgtggcagtgaaagtgttgcaccctggcctgctcgctcaggtgcatatggacctgctgctgatgaagattggcagccgagtcctgggagttttgccaggcatcaagtggcttagcttgcctgagattgtggaggaatttgagaagctgatggtccaacagattgacctgcgttacgaagctcagaatctagaacacttccaggtcaacttccggaatgtgaaagccgtcaagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcctgaagatgatatttgtggataactttgtccatgcagaccttcaccctggaaacatcctggttcagggtgccaacggcctgtcctcgagtcaggaggcgcagctgcagcaggcggacatctgtgacactctggtggtggccgtgccatcttccctctgcccgctgcgactggtgctgctggatgctggcattgtggcggagctgcaggcccctgacctgaggaatttccgggcagttttcatggctgtggtgatggggcagggccagagagtggctgagctgatcctgcatcatgcccgggccagcgagtgcagggacgtggaggggttcaaaaccgagatggccatgctggtgacccaggccaggaagaacaccatcaccctggagaagcttcatgtgtccagccttctctctagtgtctttaagttgctgatgactcacaaggtaaaatcacagtttatccctgcaccttcatagattatgttgctcgtcttagagaccaccaggcagcgaatggagtcaagcccttgcgctctccgagagtcctgccctgactacaggactagtttctcccattctttccttctccaggataaagttcctcattcctgtcttttagtgagcagtatggtttaggtggacagagattcctttggtgcagtttttttcaaggaggtgatgttattttttccttcccaggtcttgaggggacattcaaagcaggcagagaggggttgggatggctccagatggctgggagggagaacaccagctggtcacgcagcccctcgtgccagtgcgcatcaggtacagtgtggaggcgggaaagggacaaaaagacggcagtctcttccctgagcctatgccaacccagccttaaagccagtggatcgaatcaagcca

SEQ ID NO: 370119 - DNA, 622 bp, Homo sapiens
gattcctggctacatcgttcaacccccccaaccgaaaaaagagcttaggggcaccgatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370120 - DNA, 757 bp, Homo sapiens
acctcagagtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactactggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370121 - DNA, 814 bp, Homo sapiens
agtggctctgcggggaattgtgaggcggactgcgagggaaagggggccttgttgagtccgccaggattctaccatcagaaaagaggccaaacttctatcatcatggtggatgtgaagtgtctgagtgactgtaaattgcagaaccaacttgagaagcttggattttcacctggcccaatactacagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370122 - DNA, 672 bp, Homo sapiens
agtggctctgcggggaattgtgaggcggactgcgagggaaagggggccttgttgagtccgccaggattctaccatcagaaaagaggccaaacttctatcatcatggtggatgtgaagtgtctgagtgactgtaaattgcagaaccaacttgagaagcttggattttcacctggcccaatactacgtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370123 - DNA, 518 bp, Homo sapiens
gacaccatttggtttggtagcagctccttacttgctgtgcataatgataacttctccgcatctcttgacattgtatcatgggcagtgtgcctatgaagtcaaccagtacctccttttgtttgaactttggttaaattaatcatctgatttgcacatcaatctgttgctatgggggttactgatgtcacactgtcagtattatgattaccataatatctaacaggcaaaaagggactggttgctagtggaaacctcagagtgaaactcacccagctttagtaaccaactcgattgcatagactttagataaccatgtgaaggggtaagtgaattaatcatccagttggattccatttgaatatttttcttccatatgtgtgttccctctaggcaattgtctagtgccacttgaaattgttgagggctctattggaggttatttttgggaagctggtgaaacaacagacagctgttctcaggaacaaatgtcataggatctgccgaagcaagcttccagt

SEQ ID NO: 370124 - DNA, 795 bp, Homo sapiens
agtggctctgcggggaattgtgaggcggactgcgagggaaagggggccttgttgagtccgccaggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370125 - DNA, 945 bp, Homo sapiens
acctcagagtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaagagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaaaaaaaaggc

SEQ ID NO: 370126 - DNA, 651 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggaggttagtaactattaaaatggtatcagaagggacaaattaatcaagtcattaatttataatgaaacagtagaccttattgtttatgattaaaattgactcataattttcaaatgaagttgaataacattaggtagctacatttttagctttgaaaatagcttacagctttt

SEQ ID NO: 370127 - DNA, 3416 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagtgtggttctctttgaaagatgtgtcatatcatgtgccctctatgaggagttttggattaaggtaagaaaatcatgtgctcttaaacttgaatatattataaacattgatctagtgactaaccttttttgtacttctgttgaatgttgttcatataactatatctgttgcattaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaagtgagtctgcataattataattctttgttcatagatgttattagcataaattaggatagtttctttttttttaaaaaaagtttttgttccaattgtgtaatacattctttggtggttaagtactagaattttagcagtgaacacttgcttgttttcttaaacatagctgctttaattatacttttacatatggaactctgccacagttctaatatgctaacatacttactttttcctttcagtacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaaaaaa

SEQ ID NO: 370128 - DNA, 3425 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgtacatcactgaataaacttatctccaataggtactgtaagccaattaataacaaaacaaagatttttttttttttttttttttggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagtgtggttctctttgaaagatgtgtcatatcatgtgccctctatgaggagttttggattaaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaaaaaa

SEQ ID NO: 370129 - DNA, 1439 bp, Homo sapiens
  misc_feature (5)..(5): n is a, c, g, or t
ctggnatgtggacagaagggtgtggcacgtgtctgggagctgctgagtcaggttgcgggcaatgccaagagtacgtgactcaatgtgctcagcacagtgggactcatcagtatcatcatatccaatgctccttttccactctacccatgagaggtagacctcgtgccgaattcggcacgagggaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaaaaaa

SEQ ID NO: 370130 - DNA, 2930 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgtacatcactgaataaacttatctccaataggtactgtaagccaattaataacaaaacaaagatttttttttttttttttttttggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagtgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagtatgcatttgtatttttaagagtatcttctattaaaaaaaccagtggtcagtgtattttcactgtggcaactgtgatgaaagatttggtctgtatgtaatagattttattactaaatgaggacaacagtccctctaaactgatgttgccatttaaaaatttttttcaaattgttttgaattaaaagttttagacattaagattattgggttaaaattgttgtagacattgtgatactttatattttccctttagaaattatcaacaaatttactgattactaagtagaacagaggacttgggagaatacttcataaacaaaagcataggcgttgcctatgttgtaagcacatttagaagtgagatgattttgcttctccatagagtactttttatattttttatatatcaattgaaaaaggcagtgtataggtaataggtaatttctcaagttttaggattttagttattgccaggtctgtttaagatacagatttatagcagtttgcttctagctgcagtttaagatgtttatctttttttttttgagtctgtcgcctaagctggagtgcagtggtgccatcttggctcacttcaacctctgcctcctgggttcaagtgattgcatgcctgtaatcccagctattcgggaggctgaggcaggagaatcgc

SEQ ID NO: 370131 - DNA, 3196 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagtgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaatacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaaaaaa

SEQ ID NO: 370132 - DNA, 3946 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgtacatcactgaataaacttatctccaataggtactgtaagccaattaataacaaaacaaagatttttttttttttttttttttggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtttatcggcgggggcttcaggcaatacctcttagtgttgacctttggatacattatataaacttcttaaaagaaacattggaccctggtgatcctgagacaaacaatacaataagaggaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagagatttaaagaacatgtacagaataatttgcctagagatcttttaactggtgaacagtttattcagttgcgaagggaattagcttctgtaaatggtcatagtggtgatgatggtcctcctggtgatgatctaccatcgggaattgaagacataaccgatcctgcaaagctaattacagaaatagaaaacatgagacatagaatcattgagattcatcaagaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagtgtggttctctttgaaagatgtgtcatatcatgtgccctctatgaggagttttggattaaggtaagaaaatcatgtgctcttaaacttgaatatattataaacattgatctagtgactaaccttttttgtacttctgttgaatgttgttcatataactatatctgttgcattaggagatggtctgcttgcaaccagatttgactgctgcatatgccaacctcgttgcctctcttcgtccttccttacagaaactagtctagtggttcaataaaggtgctgaatgggtttaaaaatagaattttatcgttctgtcacaaatttaatggcttgttcaactgtaaattattcagtatttcctcttttctgtatgtagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaagctgaacatttgcttcaggatgccattaagaatgccaaatcaaataatgaatcttcattttatgctgtcaaactagcccggcatcttttcaaaatacagaaaaaccttccaaaatcaagaaaggtgcttttggaagcaatcgaaagagacaaagagaacacaaagttatacctcaatttacttgaaatggaatatagtggtgacctcaaacaaaatgaagaaaatatcctaaattgttttgacaaagctgtacatggttcattacctattaaaatgagaattacattttctcagagaaaagtggaatttcttgaagattttggttccgatgttaataagcttctgaatgcttatgatgaacatcaaacactcctgaaagaacaggattctttaaaaaggaaagcagaaaatggatcagaagaaccagaggaaaagaaagcacatacagaagatacaacttcatcatctacacagatgattgatggtgatttacaggcaaaccaagctgtatataattatagtgcgtggtatcaagtgagtctgcataattataattctttgttcatagatgttattagcataaattaggatagtttctttttttttaaaaaaagtttttgttccaattgtgtaatacattctttggtggttaagtactagaattttagcagtgaacacttgcttgttttcttaaacatagctgctttaattatacttttacatatggaactctgccacagttctaatatgctaacatacttactttttcctttcagtacaattatcagaatccttggaattatggacaatattatcctccccctccaacctgatgggaaaaatgtaaatttcaaatgcagtgtgtgaaaagtatgaaattattattttttttaatgagggatgtaaacagtataagcttgttgtatttgataacctgtcttccttgtttctgtgtaacatgatttgtttagtaatagggggaaaatgtcaattagtagcttaccacagatactgtttcctaccatttataaaatttactttttattgaaaaactattttttgatttttgcattaagtggtctagaattcttttgcaatgcatttgcaacagaattttgtagccttaaggggtaggaagaaaaacctgactgcaaatcatgtcagtgtagtacaaaattctgaaaacacataagggctggttatttacctccttttttttttttttttttaaagaaaaaaggacttttaacctttgctgacaaggttttgtctgtttcagttatacttgtgaattgtgatctaactgcagaaaggatacattattaaaatactttgccttggaatagattataaatgagaaaatggaatgtttgcatccctttaaaaatgaaaatcatatcaaaagtatgttgtttcaggagactttgtatttagaatattcatgtaaaacttgtgaacaagctttcattttgatcaaactgatcttcatttttgtaataaaacggaagactcatccaaaaaaaaaaaa

SEQ ID NO: 370133 - DNA, 1174 bp, Homo sapiens
atcgtgccctggaccaggcggcccgtggcgcgggtggcggctgctgtgctggctgtggggacggaggcggtgaagtgccatcttcggctaggtcgtcacaggctccggctcatggcatcaagtggcatccatcataagatcgttaactgaagacaatatgcaaaattctcacatggatgaatacagaaattctagtaatggcagcacaggcaacagttcagaggtagtggtagaacatcctactgatttcagtactgagattatgaacgttacagaaatggaacagtcacctgatgactctcccaatgtgaatgcatctacagaagaaactgaaatggcaagtgctgtggaccttccagtgacgctgacagaaacagaagcaaatttccctccagaatatgaaaaattttggaaaactgtagaaaataatcctcaggattttacaggctgggtatatttgcttcaatatgtagaacaggagaatcacttgatggctgccaggaaggcatttgacagatttttcatacactatccgtattgctatggttactggaaaaagtatgcagaccttgaaaagcggcacgacaacattaaaccatcagatgaggtgcgtacatcactgaataaacttatctccaataggtactgtaagccaattaataacaaaacaaagatttttttttttttttttttttggctggcagtacctaccatttatggtcaaacaatttttatagggtatttatttgcatttgtcactcttgtggcatttgtagctaatattttctctctttgttggcaggtgcgttaaacctctacagtttgtcaagctttgcagtgcaagcctctgtattacactgcagcttaacaagtagggcagggcttttctctcacttacatttatttctcattttccaaacaatatagttggtttgctagtcacatttgctacgtcttattgcatttttggtcagacgctgtcattgatgctctaatgggtctgtgccctatggtctgtaacccaaagcctgcccacacaacccggtcagaatgcagggactgctgcgctttgaagatcaagactctgcacgtggggatcagaacattgccatgttctatccaacctccacccaaatggtaatggtagattatttaaacaaaatgccagtaatta

SEQ ID NO: 370134 - DNA, 194 bp, Homo sapiens
gaagaaagtgtacatgcttttgaaggaagaaaaaaaaagaaaataagaaggatctcaaatcagaaacctaactttacacctcaagcaactagaaaaagaacaaactaaacctaaagttaaaagggagagactaataaagattagaacagaaataaataaaatagagaatagaagaaaaaactaagagttgggtt

SEQ ID NO: 370135 - DNA, 322 bp, Homo sapiens
tcctcttggcatatatcttttgggactagtcttatcattgttatgcatgcaaacagcaccttgcacagtgctattttcttggcaggctaccctgggagctccgtcgaatccttgccagacaggggtcctcctgatcttcagtagtgtagcactttggatcacgatgagttgctaatagttgttcttgtcttcttcttccttaggcccatatacaggtgctcctggaattatgatgggtcacaccccaacaaacccaccataagttgaaattattgctaagttgaaaatatatttaataccctgataagcccatcataatata

SEQ ID NO: 370136 - DNA, 235 bp, Homo sapiens
tgcagtgagccgagatcatgctattgcaccccagcctgggcaacagagcaagactgcgtctcagaaaaaaaataaaaataataaataataaaagagaaggaggcaacaactaggagagaagttgtcaggtaagcttgggcagcaagacaaaggtgaggatgctcaagggggagcctcatgggaggggaagaggaaatgttcctccaaagcaaacatagggttccatggagggaag

SEQ ID NO: 370137 - DNA, 640 bp, Homo sapiens
gatccatactccaaacctcagcatcatgcaatatacccatttaacaaacttgcatatataccctttgtttttaaaataaaagttgaaatttgaaaggaaagaaataataaagatcaaataactaaataattagaagtaaaaaatggaatagattaacaaaatgaaaagttgttttatttgcagacataaacaaaattgaaaaactacaagctagaagaattaagaagaaaagaccaaaataaacaaaattggatttgaagaaggagacattacaactgataccatagaaatacaaaggataattagagactgttatgaagaattatacaccaacaaattggaaaccctggagggaatgggtaaattcttgggaccataaaatatgccaagattgaactaggaagaaatagaaaacttgaacaagcaatgaaaagtaatgagattgaatcagtaacagaaagtcgttcaacaaaagaaagcccaggactgatggctttactactgaattttaccaatctttttaaaaaagaagtaacaaaaattattctcaagcaattttcaaaaattgaagaaggaattattcctaactcattccatgagagtagcattaccctgatacctacaccagataagaacagac

SEQ ID NO: 370138 - DNA, 427 bp, Homo sapiens
cagctagctgtgtggccccagccagtcactctccaagtcaaaatataaaataaaaagatcagacgaaattatcacacagtttccctccgactctaacattccatgacttctcatctgatatctatcacctttagtcatgtgaaccttcttttcaaaatgtattcttggtggccgggagtggtggctcatgcctgtaatcccagcactatgagaggccaaggccggaggatcacttgaggtcaggagttcgagaccagcctggccaacatggcaaaacctcgtatctactcaaaatacaaaaaaaaaaaaaaaaaaaaaatcagctgggcgcatgcctgtaatcccagctactcaggaggccaaggctgcagtgaaccaagattatcccacttcactccagctcggtgacagaatgagactccacctc

SEQ ID NO: 370139 - DNA, 5722 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggaaaaaaaaaaa

SEQ ID NO: 370140 - DNA, 352 bp, Homo sapiens
taataattgagtatcctgaaatagactttcatttttgcagctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctacttta

SEQ ID NO: 370141 - DNA, 2440 bp, Homo sapiens
agtcctacaaacagggatacagataatgagtcatcttttctactctcttcaagttttctactctctacatctcctctttaatttttgcacaaaataatactatgcaacaaatagtctataagtcttttagggcaccaatcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggaaaaaaaaaaa

SEQ ID NO: 370142 - DNA, 3715 bp, Homo sapiens
  misc_feature (3664)..(3664): n is a, c, g, or t
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaacntacgcgttgcataatgaattcctgggggcggtggggtgaggtgagggtggt

SEQ ID NO: 370143 - DNA, 2756 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagatcccctgacccccaagccgagccctatgcagt

SEQ ID NO: 370144 - DNA, 271 bp, Homo sapiens
aatactggagaaaataacatcgtccaagaactgacaaaggagatcatctcagaagtgcagaggatgacgggcaatgacgtctgctgtgactgtggggcgccaggtgacccagggaccccacccgaccctgggctctaggacatttcaatcccattctgattcacagaatccgttcattgattttcactttcatttcaaacacgaaattaagtgcagctcagcctgagttcatcccattacacaaatgcttaatgaactgtgcagaccgcgg

SEQ ID NO: 370145 - DNA, 783 bp, Homo sapiens
gatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttggtgtcagcatctcttcccccagggtacagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatgcatttgccttggactagaaggcaggcctcctgcctgcacacttcagtgggtccagatgcatggccgagtgtatgagcaacagcactgaccatccctctgttctctcagctgacccaagccttatctggaagatttaattctcacgttcacgttgaatatgaatggcgactactccacgaagacctggatgaaagtgatgacgacatggatgagaaattgcaggtctgtgccaggttgctaaccattaagagttttgatcagcttcatccagaacagtgtgggtcctaatct

SEQ ID NO: 370146 - DNA, 5447 bp, Homo sapiens
atcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggaaaaaaaaaaa

SEQ ID NO: 370147 - DNA, 5669 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggaaaaaaaaaaa

SEQ ID NO: 370148 - DNA, 4314 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaattaggtatggttggaaagttttaatggttaaggtaggtggggaatgcctgtaatcgggacgaaactgttcggaattggggccagtttacacttgggcccaggcacgcctatcgaggtattgtgttataccaggggctaaacagttaaacaatgcgcctgttttttttttttgattttttatttgtctcataattatagtaaaataagatgtcatggatagaatggtatataagacg

SEQ ID NO: 370149 - DNA, 2667 bp, Homo sapiens
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcaggggtgagccccaggaaggttgctgccttcacgcaggacttggagctgagagtcagacttaggccttgtgacccaaagccctggctcctagccgcgacccacttccatctgtccttcagcatggtgcttcgaggcatgtctggaatgtgctctgtgctgaattagtggcaaatgccacattaaacacattttcatgga

SEQ ID NO: 370150 - DNA, 432 bp, Homo sapiens
acatggccttagacaaagggaggccggacggcgggtagaagcccttcatgatttgcaaggcaattacgtttggtttcaggaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctactttaaaaaaaaaaaaaaggccggccacggtggctcatgcctgggatccagtactttacttcaggaggccaaggcggaggatcctttgagctcaggagtttgagatcagcctgggcaccatagggaggccccatctctaca

SEQ ID NO: 370151 - DNA, 2983 bp, Homo sapiens
taaaagggccacgaattaagcccaggagtttttacattttatcgtggtggccttttgggcacggttgcgccaccaacgttgaccccagggaagttccattaggtttccgaggctttaaggataagcggcacttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370152 - DNA, 1981 bp, Homo sapiens
  misc_feature (22)..(22): n is a, c, g, or t
cggctaggtcgagcccggggtnaatcggccgagggcttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370153 - DNA, 2929 bp, Homo sapiens
taaaagggccacgaattaagcccaggagtttttacattttatcgtggtggccttttgggcacggttgcgccaccaacgttgaccccagggaagttccattaggtttccgaggctttaaggataagcggcacttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccatagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370154 - DNA, 878 bp, Homo sapiens
ctcttcagctgtgcttgattgtgtcctttcttatgcctggttcagctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370155 - DNA, 6044 bp, Homo sapiens
taaaagggccacgaattaagcccaggagtttttacattttatcgtggtggccttttgggcacggttgcgccaccaacgttgaccccagggaagttccattaggtttccgaggctttaaggataagcggcacttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaactcactctagcctgggtgacagagcgagaccttgtctcaaaacaaaacaaagtgctggaattgcagacttgagccacagtgcccagcctcacttctctagactatgatggttttttcttcattctataatctcttttccaaattggttcaacattttgtgaacactattaatttcatcattcagtatatgtgggctttctaaaatatgccaatttttttccacttaatcaagtttgacttaatttaacaaagtgattatattttaatagttacatttctgttttttccactcactagccagcttacagtttattagcccttgatttcagctgaaaatattcatgtctgcaccccttcatgatagttctttctttacgtatacatactgtattcaatatgcaagaacaggcaaaaactactctattgtgataaaaatcagaatagtaattgcctgaggaaagggatatgagagaacttgagagaactttctcggggtgatggaaagtttcttatattgatttgggtaatagtaacatagctatatgtatatattagttaaaattcctcacactaaacattttaaattgatatatttacatttatgacaatatacctcaaagtaagttagggtaagaaaagataattacttacatgaaataaacaatgacctcttttatatcaaaccatatacatgtgtataattagggtatgtattatgcacagagaaacaatttaggaaaatccaaggaggggacgttttatcttcttacctatttactgaatgcaacattactgcacaccaagacaaaagagctctccaggaaaacattggatatattgagagcattaaaagatactgcaaaagctctaataaattcagtctgcttattttccaaatttcataaactacatacttaggaaactgtgctttcagtgagctaaacttctttttttaagtaactatcatagttttaagaaaaacattttaagaagacaaaaagtatttattaagcccatctaaaaggctaatgcaaattcccaaaaaaggagcacatagagatagaggaggaggccgaagtggtggctcatacctgttaattccagcactttgggaggccaagacaggaggatcactttaggcccagagttggagaccaacctgggcaacatagcaagaccctgtctcttaaaaaaaaaaaaaaagacgggagaagctacaagaagaaaactagaactttagagcaggagtaaaccttagagcatgtaaagtccattttggagatgaggaacagacccaggaagatgacctggcttccctgaatcccacggctagttagtgcagacatttcagccataacccagctcttctaattcccaaatactctttcttctactggcacatagagatgggggaggagtcagggcatggtggcccacacctacagttccagcactttgggaggccaaatgggagaattgcttgaagccaggagttggagaccagcctaggcaacacagggagacccgtgtcgacaaaaaatttaaaaattagctgggcatggtagcacatgcctgtggtcccagctactcagagggctgaggtgggaggatcacttgagccccagaggtcaaggctgcagtgagctgtgatcatgctactacactccagcctaggtgacagagtgagaccctgtctcaaagggagggaggtaagaatgagaagaaggaacaggggtgtacctcttttaagggcccaagtatcctgaatggctcagcagtatagaacattgtggtagagaaattacattttaaaataactctaataccgtttagaaacaaaaccctaacttctgcttgagataaactgaagtgcatctgtcccttgtccaggagtggggaaccattgtagggttgctcagcataagtcatactgccacggtgaccttgaggagtgcagggattccctgaaggaagcagctggtaccagacacttaggctgcccatttgtgttctgatcatttgagtgaaaaaaaggtacctgtcaagcaagctcctggacaccacaagaaggaggaattattttaaaagctgtactcttaaattgttagtatctttaaaatcagttgtgaacaatgaaggatttgaaagagcattgactttgccacttaaaagtatttctaaaatactttgtgcttcccccttgcattctgaatttatacacttttcctcctgctgttctcagacccagtggaaagaaaatctcaaggaagaaggctgagtttattctctcagggctctgttgggtctacctcatctgaggtggcttattcttcataggaaattaatttttcttctcaagtatgcacttaaatataattactgcttccttggtcctctagcagatttctcacttttatttatttttttttttgagacagagtcttgatcttttttcatctaggctggagtgcaatggtttgatctcagttcactgcaacctctgcctcctgggttcaagcaattctcatgcctctgcctctcgggcagctggaattacaggcatgcgccatgacgcctggctaatttttgcatttttagtagagacgggttttcaccatgttgccccggttgctctcaaactcctgacctcaggtgatccacccgcctcagcctcccaaagtgctgggattacaggtgtgagtcaccccgcacagcctgaaatgaggcatctctatctatagtccagcagccctacaggaggcaggaggggagcaagaataagaaaggaaatttgtaaaaggcacttaggagtgagcagaaaggaaataggaccagcttttacctgcccagtcctggccagtgacaagcagtctgcttgagtctgtgctaaataaacaaaggaagttccatttagagctctacagaggggaagccatagaaattaacaggatgaaaatacaagagacaggaacacagatgaataaatgtaataaaatttgagaaat

SEQ ID NO: 370156 - DNA, 2652 bp, Homo sapiens
cagtccatggccgacttccgcgcagcagcttctgcatttgctgtttcctacctgctccacccctaccagctcaggcgtcagcaccgccaggccccgtaaaggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370157 - DNA, 1978 bp, Homo sapiens
taaaagggccacgaattaagcccaggagtttttacattttatcgtggtggccttttgggcacggttgcgccaccaacgttgaccccagggaagttccattaggtttccgaggctttaaggataagcggcacttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactgttcctggaaaacaatggaaaggacaattcaccacagtccgaaaaagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370158 - DNA, 1930 bp, Homo sapiens
taaaagggccacgaattaagcccaggagtttttacattttatcgtggtggccttttgggcacggttgcgccaccaacgttgaccccagggaagttccattaggtttccgaggctttaaggataagcggcacttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccactggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggctta

SEQ ID NO: 370159 - DNA, 476 bp, Homo sapiens
tagagaggcaacatgccatcctgagagaatacagggctggtgcctcaaagtttttccacagacaaggtacgcagcctggggcaaactattttaactgcagctttctcagctgtgaaaaatgagaatggcaatccttactgctttggaagagagttgtgtttattaattagtttgtatttcaaagtgcttcacaactggaaagtttcactattggattaaggaaaaatttcctttcattttatccctctccacattaggatgaaaagaaactgtgcttgctgaggctgggagaaaaacggaggggattcaggcaaaaaagctaacaaacctgacttccatggtagtggctcatttccccggctgtaagatggcacccattaaagggagctttgtaaattaggtatcttaaagggcagccaaacctgccatctgaagaattacttttgttttagacttaatttttatgattgcttcaa

SEQ ID NO: 370160 - DNA, 2029 bp, Homo sapiens
  misc_feature (2023)..(2025): n is a, c, g, or t
  misc_feature (2027)..(2028): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggagcaggtgggactgggggtggtccagaccgactggagccagagatggtaccgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370161 - DNA, 2603 bp, Homo sapiens
  misc_feature (2597)..(2599): n is a, c, g, or t
  misc_feature (2601)..(2602): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370162 - DNA, 3400 bp, Homo sapiens
  misc_feature (3394)..(3396): n is a, c, g, or t
  misc_feature (3398)..(3399): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcctcctaggattgcccttgacttccaggtctccagccgcttacctctgcgagtttctacagtctccgactatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcactgaagagcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370163 - DNA, 3537 bp, Homo sapiens
  misc_feature (594)..(594): n is a, c, g, or t
  misc_feature (3531)..(3533): n is a, c, g, or t
  misc_feature (3535)..(3536): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtggagggcgcgagtgaagcgatggacgtttctgggaagaatcattgcgcactatgtgcgtgacattggtcacaacacaaaggcacacactcgcaaatgtccggagaccgtccntgcgacgagaggcacctcgatgaggacgtagggcactaccacacattccaacgtggtactcgttacatggtccaaaccctagttagccttgtcttggctatcctcggatcgtcacaaagtcgagtcgcactggctcttgtcaaaggattcgtcgtagaggcaatgtctgggggatacccgcaggggagagatgcgggacgtcgaacttgaaggcaaaaatgggggtggcaatttgggctaaggcccagggggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcctcctaggattgcccttgacttccaggtctccagccgcttacctctgcgagtttctacagtctccgactatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggtgagaccccttccccaggtccttcctggactggaatcctgctatggagttagatcatgtcctaaccttcagctcaggcagctctaggcctgcttcccgcccacctggatgtcctgcttttggccaagtcagcttgtctcaggtctggtctctcctcccatccatgtcgggtccccccaaccccctacaacaatagtgcttgaactagagactctttctcggccagcttcttggcaaaggttttaaataacacatgcctctggctgggttctgtgctctgccagtcgagtggccctcgtcagcctcatccactttattcttacccatcttttcaggcttcactgaagagcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370164 - DNA, 2411 bp, Homo sapiens
  misc_feature (2405)..(2407): n is a, c, g, or t
  misc_feature (2409)..(2410): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370165 - DNA, 564 bp, Homo sapiens
gccaaaccacccccgcagctcctgacagaaccagaaattccagcgcaaccgaggaggcgggagagaaagagagagagacagacagagacagagctacgcacagccagggaggggagggggctcacacacatgggaatggaaccccccatacacatgcagtgggcaggaggcagtaattcaataaacctaaactgagcccatcttcacagctttctttgcccctgcttctgttcccaaccacctctgtctgcagccagtcaccctgcagtctcctaactgcccccttttccctgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttca

SEQ ID NO: 370166 - DNA, 514 bp, Homo sapiens
  misc_feature (349)..(350): n is a, c, g, or t
  misc_feature (356)..(356): n is a, c, g, or t
  misc_feature (361)..(362): n is a, c, g, or t
  misc_feature (369)..(369): n is a, c, g, or t
  misc_feature (373)..(373): n is a, c, g, or t
  misc_feature (375)..(375): n is a, c, g, or t
  misc_feature (388)..(388): n is a, c, g, or t
  misc_feature (393)..(393): n is a, c, g, or t
  misc_feature (404)..(404): n is a, c, g, or t
  misc_feature (424)..(424): n is a, c, g, or t
  misc_feature (431)..(431): n is a, c, g, or t
  misc_feature (444)..(444): n is a, c, g, or t
  misc_feature (465)..(465): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcnnagtgcncgagnnatggcantgcntnggaagattccccncagcnacagtgtatcncgaagttatatataaaatanaatggangttgatcttatangaatgaattattccactcctnctttgtaacatcagcttgcactacccgtatcgcctcgggagcttctgat

SEQ ID NO: 370167 - DNA, 3052 bp, Homo sapiens
  misc_feature (3046)..(3048): n is a, c, g, or t
  misc_feature (3050)..(3051): n is a, c, g, or t
ccggcagccagcgcagctccgggcctcgctccctgtgcgtcctgcgggggcggaggcgcggagaggcggcaagcgcagccggggagggtgggggggcagaggcacagacagaggcgcggaggctcggagagagaagacgtggagggagggacagagcctggacagcggtggacacggcatcgtgcgcggggaagagggcagcacgcagcaggcgccgagcgccgggcaccgagaagggcagcccgggtgatctccggccgtccatgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgaggtgagaacccccaggcctcctaggattgcccttgacttccaggtctccagccgcttacctctgcgagtttctacagtctccgactatctttcattatctcttgaccaggaccccaggccctgatcccctccccaacaggcccctaccccagcggccgcagtgcttccatcctcagctgagggggaagcagagatacaggcagcaccgagctgttcagctccttgtcactcaggaccccacaggagaggaggaggccccgggcattcctaggaagctgtgggtgctgacctctgtcttcccacctcagaaagctcccatgtagtgtcaaaaccaaagcaagcgtctgatggatgggcctcatttgtccaatggtgaaggggtgtgaggaggtctggtgaggcagcggggaagttcgaattctgactctcctggctgccctccctccacagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtgagggttggactggtgtcttcagacccaggacctcagacttctggctcacacagacccccacgctctccatccccggaatctagtcacaaccctggatccttcctctgcccttctcctgcctccccacctgctccatgggcataagactgtggggcttcaagcaataacaagcagaggcctggagagaggacacaaggagggtgcgtggtgccctcacccctgcccagagcgagggggcaaggactctgcctccagggcatctggggttttcccctccctcacacaacacactcccattctctttaggtttgcaccagtggtgtgagcagttggactcagtttggacaagggggaaagggggacttccctgggaaggtccagctaaaagtggcaacatttgcccccagaattgggggcctgggaacactggacctgctccttctcccctctccttccccgtttttgtgcttctggtttgtttctttaattaatttaacaagtgctgcagtttgccctcccattcccatctatcccccaagtcctttgcaatttcttccctgccctacataggggcggtgggtgtgggatcccttcactggccccctcgggaggcctgggttggactcagggtctcctccagctgggggctggaccgcagcacctatctgagcagttagagcgtctttcttttcagattgtgtacagtagattatttattttgttattttggaataaaatttattttatggcttaggannnanna

SEQ ID NO: 370168 - DNA, 447 bp, Homo sapiens
cttggcaaaacgggatcaaagtacatgaaagatgacagcctggtgaactattatgggaaagctggaaacttggcttttggggagatgctggccatcctgctgaaatctttagcggggttcagagatgtctctttgctcatttcctcctaaagcatgagttgtttgcagccttaggttgctgtcttgaatacagtagagctgggaaggcagtagcttggagaactggtaccagccttttaaaatcctagttccgattattggtagttatgacaaaggaagcctttgattaaagtctgtgaacttacatgtgggaaaatgatgagcaattctcaaagcaaaaaggaaaagccgtatattaccagtgaggtttggcgatctatagcagttgtttcttttggctttcacaacatagcttggccctcagctcttgtcctcctaatagtgagc

SEQ ID NO: 370169 - DNA, 763 bp, Homo sapiens
tcattgccctcaccataggagaagtacatcagaggattttaaggaagagaattgtgcatctggtccggggattgcaggcaagatcctcttcatggagaagatttatgcttaagctgttccttgagaggcagtgttgttctgtggctaggagtgtgggatccagggtcaggttccctgtgtttgaaccttgatcagcctcaatgtcctcacttgtacgattgctagaataatcctcttgcctcagagttattgtaaatattaaggaactaatactcataaagcatttgaagcactgcctggcctatagcaagcacttactgaatgttagctataatcacttaaacagacacaggtttggaaaaggacaattctaagtttaggcagtgatactgacggtgtatttaggggtttctaataattggttactcatagtcattcacggagcctctgcctttctagtctcccactatagaggctgaaacatcgcagtcacttttccagcctcccctgtagccatgtgacccatttatggccaatagactagagagggggcgttgaggaggacctctctttgcaggcctctcccgtccccagcgttggaacacaggtgtgaacttggtgcttgccgcagctgctactgtcatctccccaccttgaggggaggaccaagagagttaccaactgtggcccggatccctgaccttgtacaaccagtgaagcaaagcacaaagccatctgcccccagaattcacgttatgtggaa

SEQ ID NO: 370170 - DNA, 743 bp, Homo sapiens
tttcccgggccttggcggagctccgggaccgcgcagggcagcgccaggaacacgatgaacaggatgagcttccgcgagcggcggctctcctgcagccagcggaccagcgccagctcgctcagggccatggctccggggctccgctgcgggcgcggtgcgcggtcccttttataagcaaaggagaaacaaacagatgccctctgacatcgctggagctctgcaggccctccgaggggaccgtgggagcaagagctgttttcttgaaaagctacctagaataaatgttaccctgtcacagtctcttagcagaagagtggccttgttttattaatgttagcttgttgacagcaggaggccactgagaacagcagtgtgatgtgtggctgcccccgctctctccacctccctactcccttgcagagaccccctgtgcttctcattgctaccccatgtgtgagaagagatggttgaataggtaagtaggtcaggaacatgggtctccaggatgtcacaggatgtgcacaacttaaacattaaacagggaggacagaaggaaaaccacttaggaggaggaagcagatggcagagagccgtttaagatggcaggagggtatcactcagggagtgccccagagtgcttgctctggagtttcagaacccaaggatgcagactctaccccagggaccacatggggacagagaggcattatggtaaagggtgcctgccaggatgcccaggtccc

SEQ ID NO: 370171 - DNA, 739 bp, Homo sapiens
cctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgaggtggaggaaccactgagtcaggagagccaggtggaggaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 370172 - DNA, 398 bp, Homo sapiens
cttagagggtccccctagtttagaatgttatagcatgcattgctgcctgggggtctgggtttaggtgctattgaaacttctaaaagtaggcctcgcacctcagactcccagtaggggggattaggaaccactgagtcaggagagccaggtggaggaaccactgagtcaggagagcgaggtggaggaaccactgagtcaggagagccaggtggaggaaccactgagtcaggagagcgagatggaagaactaccgagtgtgtagacggccagctactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 370173 - DNA, 558 bp, Homo sapiens
cctggagttagtcgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgatgtgtagacggccagctactcccctatctccgagagcagcgactaagttcaggcccagccgccagacctcagagatctcaccagcggggtgcttgccattctgaagataataaaatgaatgtgttgcaaattgaaaaaaaaaa

SEQ ID NO: 370174 - DNA, 1154 bp, Homo sapiens
gtattggtttcacacaatttactctaaggcgcccacctaatagagctcaggcaacccgtgggaacctgacagtcccaaacaggtctgtaccctgtgtggctgcaccacaagcccaatgccctcggctttcctagggaaagcatggtgccaggtgcagatgctggccctctgtgctgtgggacagtggtgtgggagccagccagctaaccataccctgctgccatccccaacatccccaacacatatttatatttagtttctgttctcctccccttactctgtcgcctcctcctcctcctctttgtgtctttcccacgcggattctttctctttcctctgagtggacaatactgtaggcctgacccgcttagacaaactctgacctcctgtggtcacccaggaagctgactgctaggccttggatgagggggcagtgggagggggaccaggtgataccagaatggctccccccacagattcgttacccaaggacatgggtacactggtcgaatgctggctgcagaagcagaatgtgctgcgtggaggtggcagagattggttgctgaggatttgaaatgaaccatgaaccaaagctagaatgaaagcattatattgtctaacctagaatcgacaccctaaattatttttactgattcatgaatgcatatgtgaattattttctttgactacaaatgccttatatacccaaatcacagctccaagcagtacttttgaacagaactacaataaagtatgaatgttagattattaccagaaaaaccacaacaaacaactcaccaaccacaacacacaaacaaaccacaaaaccgcacatagtaaaacatcaaaccacacaactccaaagagaaagagagaggagaggaggcggcagacaaaagtaagaaaggaatgagaagagagagagaaggaagagagagcgcggggagggagacaagaggggaagcgccgaagacaaagaggaagaaagggcagaggaagggctaacacaagggatggacgagccaggagagaaaaccagtcggcagagagcaaagacaacgtaaaggagcaagccagaccacgcccctcagaatcgacagaaacaaaaggaaaagaacagagacaagggagcagagaaaaagcgaggaaaaggt

SEQ ID NO: 370175 - DNA, 371 bp, Homo sapiens
cccaatttcaaaatgttaacagctagttcagaattgaaacaaaacaaaccctacggagagcaaatcaaacactttcataggctggacggtcccttgagtcagtggtcacgggctctgtcctaattttacagaggtcacaatttgaagcttccaggtggggctgaggggacaggaagggctcttggttggcctccgcttgcctgccttgtgtgacagggggctctcgctctgcaagggcaggctgtgtctctgttagctgtttctccctttgagaagagcgtccttgagtggttttctacttggttgaaataatcataaacacaggagaatgatgactcaccaagacgttctttgctattagtatcatgatg

SEQ ID NO: 370176 - DNA, 353 bp, Homo sapiens
  misc_feature (19)..(20): n is a, c, g, or t
  misc_feature (96)..(96): n is a, c, g, or t
aaaaaaggaaaaaaagggnnaacccccctttgggccccttttggggggggaaacccccccctttttcctttggaaaagggggggccttttttttgnaagaagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370177 - DNA, 5494 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatggggctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370178 - DNA, 5500 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaagtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370179 - DNA, 1205 bp, Homo sapiens
tcacctgaggtcaggagttcgagaccagcctggccaacatggcaaaaccctgtctctactaaaaatacaaaaattagccaggcgtggtggtgcatgcctgtaatcccagctacctgggtggctgaggcaggagaattgcttgaacctgggaggcagaggttgcagcgaactgagattgtgccactgcactccagcctgggcaacaagagcgagacctcatcttaaaaaaaaaaaacaaaaaaaactgatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370180 - DNA, 5554 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370181 - DNA, 5494 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccagtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctaaaatttctcacctgaatgtagtcctgggagagtcccgatcacgtctctcctgacatgttcactgaaatcggagacaagaagttacatggatgatgggatcttatagggtcacacaaagacaatttggcagcttatcttaatttcctgcagtgagacaacacatgtggaactgggaaggacagctgttgttacgagcagtttttcctggtcatggttgtaaagctctgtaacccacattgtaaagccgtgaatgtttttagtcttgttgacgagtttttagagactgctggacctctgagggctttgagagtgcagctgtgatgatgtttcactattacttcagtgtgaatgtagaaccaaggactcatcttcattttatacctaaaagtgccttgtcaagaaatttttgcatgttttaaaagataaatatttttgtacacagagttcaaggggaaatgcactttaaaaatcccaagaatggatgttctttgtgtggtatgagaggttggtttgtatctcaaaagcaaaaatgtaataaaggaagacaaaacaaaaaaaaaa

SEQ ID NO: 370182 - DNA, 5078 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcctctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatttccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgctttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatctaataatgatcttaagacattcccatgtcaaaatttgaaatatggtaattcagtgataactatctcttctaaagcagccgtaaaccctccccactacccgtctttctcccagctcaccctggctttttttgctgggggtgctggatgcaagcccccagccagcacacctgggatgctcaccctgccgcacagttcagaaggcaagtcctcacctgctcgcaaagacccttcttctccaataaaagactctacttgcctgagtttcctcatcagggctgtcattcagtgatgtatgggggtctgaagaatactgccttctatctgtcttctgtttaccacttgctcctctgctaccctcctgccgcaaacagtcttcttccttttggcccagttctgtcccgtgaaattctcagaaggcctcgggagctgcgctgatgtattctctccttgtttgatagctcatcatcagtagataagcctacacacttcagagggtgacaggtttcttacttggagacttcactgcaccttgacttgtagatttgccttcagacagctcttggttatggttacaagtggcccccgagtcccagaatctttcccaggttgccccagaaagaccagccacctgtcacaggtgcagttgtccggcaatagggaagcaacttcatttttgttttatatttattccctcaagtgccctgaggagcatttgcaaactgggtacaataaataagctggattatacaaagatatttaataaataagctttcagtatctattggaagacatgaagcatttgagtgggtttctttatttaaaaaattattctactggagctggtgagaaataatgaagctgtacagttctccagaaattaaaacaatgtcagagtcaatgggagaatttaatttacctttaagatttcattttaatggtggcaaaattatacattcttagaagatgtaaatttggaactgttaggagattgctctgtggttttgatcttttcaaaccattttctttttgaaaaaaggcattagttgtagtcatggacattaaatgggccatatatgcttatcaatcaaaaaagtgttccttttttggaactgcccattttctggatcttccctctcaatggataggggatgaaaaccttggttgccttttatttgtttcctcttctacatgaatccgaaacatgaagtccatgatgaaggaacttataggtcacccaagccaatgggccgttacttaattccttgagggaaa

SEQ ID NO: 370183 - DNA, 2870 bp, Homo sapiens
caggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370184 - DNA, 1150 bp, Homo sapiens
agttatcaccctataatcgtatctgctttcatcttgttgtgattatgtgtgctggtgtccaaattcaggatatctggaagctccttgtagagcttttgaactttgagcttctatgctttaataatataggaagtcactgaaacagtctatagttttttatataataaacatagcgttttcttttcagactctaattttagccacaggttatcatttaccttataataatagtcttttatttgttataggatatgaaatatatgtacattttgtacagatgtgtaatgcagtttcctaaagtttaataaatatgcttttttaaataatagctttgttgagatataattcccataccacacaacttacctattcagttgcgaaccatcatgacaattttagaacattttcatcactcatccccccaaaaatccccatacacattaaatattttcttaaaaaggaaatcgtgaaggaaaaatcaatagtatgattacaatattaagtataaaacatatatatgttttacattaattaaattttaaaaattttaaaaagttttaaactcacataaccaaaacagaggagcaaaaaggagaaaatagatgcagcatatgatgtagacaaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagctgaggcaggacaatcgcccgaacccgggaggcggaggttgcagtgagccgagatcgtgccattgccctccaacctgggcaacagagtgagactctgtctcaaaaaagaaaaaaaaaaaggaaatattcaacagtttaatattttgcttcaatctctttatagactgtatcataaacttttcatttttatttttagaaatcttttcccccgtttttcttttttgctattttctccaaaatgggaaaggttattgata

SEQ ID NO: 370185 - DNA, 506 bp, Homo sapiens
caggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaa

SEQ ID NO: 370186 - DNA, 2863 bp, Homo sapiens
caggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattatttcaaggaggtaatacgtccacccgg

SEQ ID NO: 370187 - DNA, 2861 bp, Homo sapiens
cgcggtgcctttcggctctgggaagctccgggcgcccaggcttgggcttcgtcgtggagcgtttgcgcggccagcttggggaagggtcgtttcaaggttgggcttggaggagagggcagtagccgagtcccctctgccctaaagaacgagaagaatcgtgttctatgcctggaggacagaggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370188 - DNA, 2831 bp, Homo sapiens
caggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattattgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370189 - DNA, 2346 bp, Homo sapiens
tgggaatttggtgttttgacatgaatgctctctgactttgtttttgccctttggctgtgtacctagtgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370190 - DNA, 2449 bp, Homo sapiens
tgggatgagagacttctgagccagtgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagattggaccatgtggaggtagggagaatagaatgtcatgttctttcactgaagccatgccgtgagcaactctatccaaatagaatgtcacacctctcagttggagacccaggaggactgaccgtgtgccaagagtgaggacaggagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370191 - DNA, 5115 bp, Homo sapiens
  misc_feature (1846)..(1846): n is a, c, g, or t
  misc_feature (2181)..(2181): n is a, c, g, or t
  misc_feature (2351)..(2351): n is a, c, g, or t
  misc_feature (2359)..(2359): n is a, c, g, or t
agttatcaccctataatcgtatctgctttcatcttgttgtgattatgtgtgctggtgtccaaattcaggatatctggaagctccttgtagagcttttgaactttgagcttctatgctttaataatataggaagtcactgaaacagtctatagttttttatataataaacatagcgttttcttttcagactctaattttagccacaggttatcatttaccttataataatagtcttttatttgttataggatatgaaatatatgtacattttgtacagatgtgtaatgcagtttcctaaagtttaataaatatgcttttttaaataatagctttgttgagatataattcccataccacacaacttacctattcagttgcgaaccatcatgacaattttagaacattttcatcactcatccccccaaaaatccccatacacattaaatattttcttaaaaaggaaatcgtgaaggaaaaatcaatagtatgattacaatattaagtataaaacatatatatgttttacattaattaaattttaaaaattttaaaaagttttaaactcacataaccaaaacagaggagcaaaaaggagaaaatagatgcagcatatgatgtagacaaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagccgagttgggcagatcattttaggagttcgagactggcttgatcaacatagtgaaaccctgtctctactaaaaatgcaaaaatttagccaggcgtgggggcttgtacctgtaatccaaggtactcaggaggctgagacaggagaatgacttgaacctgggaggcagaggttgcagtgagctgagatcacaccactgcactccagcctgggcgacagagcaagatagcatctcaacaacaacaacaaaaaggtgctaatgctggaggtggtatagcaaaattttaaattttgctggtagctatataaagtctttgtttttatttttagtttatttatatatttatttttgacagctcctgcagagcagggctactccacagggattgtgctgagagtagtctataaattcttaaagcagtttatcagtatctattaaaagccttaacaatgtttattccctttaaccgaataattccaccgtggtcagtctatttgaagaaaataatcttaagcatacataatattgacaaagatttagtccagcattcctcataatggcaaggaactggaaacaaccttggaaataagtaaaagaagatagagtgaagtcccatcatatatgtatgtatcttctacaacaaagttcactgtgcttacaggtgaggaaaagaaaggaagggaattaaaatagtgcaagtgtatcaaagcatgtggcctgcagccagcctgagatgggagattggatgcttctccttaggtcggacttagtttcctgtgtctcttaatgggtgtttcagggctgagtgcgactcagggttgaagacgagaagcttttgtccctggcctctaaatgtcacctggccactgtccctcacctagtgctcaaccttggaaacccttttcctctgtgtctctttttaaagaaatttaataaattcttattgtctgtttgnaatattcaacaatttaggctgggtgcggtggcccatgcctgtaatcccagtactttgggaggccaaaagagggtgggtcacctgaggtcaggagttagagagcagcctgaccaacatagtgaaaccatgtctctactaaaaatacaagaattagccaggcatggtggtgcatgcctgtaatcccagctactcgggaggctgaggcaggacaatcgctcctgggttcacgccattctcctgcctcagcctcctgagtagctgggactacaggcgcccaccaccatgtccggctaatttttttgtatttttagtagagacagggtttcaccgtgttngccgggatggtctcgatctcctgacctcgtgatcaacccccctcagcctcccaaagtgctgggattacaggcataagccatcgtgcctggcccaccataggaatttatatactgacatatatataagatttttagctcagttctttttatgatacagttaccttatatgnccacttantgaaatactatatggctattcacagtgatggctatgcagattatgtaatagaatagaaaatttatgcctatagtggtataagtgaaaaacataagctacacagttataataactaggtagaaaaacgcatagaaccaaaaagactggaagaaagaacaattagctttcaggtgccatttaccaattgttgggcatcttttttttaaaaatgatttattgtcaggcatcttttagcccaggtatcaaaatataaaattgaccaaggacttagtgtacatcctatatgtatatatatttttaatcgatttctatgcagatgtttctgcacacctgtccgtgatttgtccctccttcccacttgataactgtgtggcccacagaattctttgaccatagtgattggacttcagagtgaagaagtccagttgcttgtcagtaccttagtagtattaccagaatacccagtttttgctagggtatcatatgatgcaggagggcagttactagtaatgtttcttaggtaaattctttgagctgagagacaagttagagaattccctttggagatcaattaaatttaggcttagaaaagtagaagaaacagactttattacccattaagagttctctgagctaatcagtctggttaacaagttatagagatatgctagagggaatgtctcttgaagtccagggtagagttatggaccaagttgggagcagctaccgaggtcagtctgggaaggtaagctaaacagctaggctggttcactgcctgccagagatgtggttgaggatcaccatccacgttaacagggtgcatttcaagaaagtgaaagtgccactttgaattgctgctctttgacacatgtcaaagttcaggagaagggacatgctgtgcgtaggacatggggaagatagcagttgtaccaagaatgaatggaagaggaaggggagcaggaaaccttgactattcccccaggtgagaaagtggaattaggtcattgatacttggctggatctgccgggcccttactgaccctttgcccttcaacaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370192 - DNA, 1550 bp, Homo sapiens
  misc_feature (7)..(7): n is a, c, g, or t
  misc_feature (15)..(15): n is a, c, g, or t
  misc_feature (17)..(17): n is a, c, g, or t
  misc_feature (21)..(21): n is a, c, g, or t
  misc_feature (24)..(24): n is a, c, g, or t
  misc_feature (37)..(37): n is a, c, g, or t
  misc_feature (42)..(42): n is a, c, g, or t
  misc_feature (46)..(46): n is a, c, g, or t
  misc_feature (75)..(75): n is a, c, g, or t
  misc_feature (77)..(77): n is a, c, g, or t
cgtaccngcggtggngnctgntanggacattgtggtnccccngggntgcagggaattgggacgtgcagaaaacgntntcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370193 - DNA, 618 bp, Homo sapiens
  misc_feature (17)..(17): n is a, c, g, or t
  misc_feature (22)..(22): n is a, c, g, or t
  misc_feature (25)..(25): n is a, c, g, or t
tgcggtgactctagagnatccngtntagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370194 - DNA, 3805 bp, Homo sapiens
  misc_feature (1846)..(1846): n is a, c, g, or t
  misc_feature (2181)..(2181): n is a, c, g, or t
  misc_feature (2351)..(2351): n is a, c, g, or t
  misc_feature (2359)..(2359): n is a, c, g, or t
agttatcaccctataatcgtatctgctttcatcttgttgtgattatgtgtgctggtgtccaaattcaggatatctggaagctccttgtagagcttttgaactttgagcttctatgctttaataatataggaagtcactgaaacagtctatagttttttatataataaacatagcgttttcttttcagactctaattttagccacaggttatcatttaccttataataatagtcttttatttgttataggatatgaaatatatgtacattttgtacagatgtgtaatgcagtttcctaaagtttaataaatatgcttttttaaataatagctttgttgagatataattcccataccacacaacttacctattcagttgcgaaccatcatgacaattttagaacattttcatcactcatccccccaaaaatccccatacacattaaatattttcttaaaaaggaaatcgtgaaggaaaaatcaatagtatgattacaatattaagtataaaacatatatatgttttacattaattaaattttaaaaattttaaaaagttttaaactcacataaccaaaacagaggagcaaaaaggagaaaatagatgcagcatatgatgtagacaaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagccgagttgggcagatcattttaggagttcgagactggcttgatcaacatagtgaaaccctgtctctactaaaaatgcaaaaatttagccaggcgtgggggcttgtacctgtaatccaaggtactcaggaggctgagacaggagaatgacttgaacctgggaggcagaggttgcagtgagctgagatcacaccactgcactccagcctgggcgacagagcaagatagcatctcaacaacaacaacaaaaaggtgctaatgctggaggtggtatagcaaaattttaaattttgctggtagctatataaagtctttgtttttatttttagtttatttatatatttatttttgacagctcctgcagagcagggctactccacagggattgtgctgagagtagtctataaattcttaaagcagtttatcagtatctattaaaagccttaacaatgtttattccctttaaccgaataattccaccgtggtcagtctatttgaagaaaataatcttaagcatacataatattgacaaagatttagtccagcattcctcataatggcaaggaactggaaacaaccttggaaataagtaaaagaagatagagtgaagtcccatcatatatgtatgtatcttctacaacaaagttcactgtgcttacaggtgaggaaaagaaaggaagggaattaaaatagtgcaagtgtatcaaagcatgtggcctgcagccagcctgagatgggagattggatgcttctccttaggtcggacttagtttcctgtgtctcttaatgggtgtttcagggctgagtgcgactcagggttgaagacgagaagcttttgtccctggcctctaaatgtcacctggccactgtccctcacctagtgctcaaccttggaaacccttttcctctgtgtctctttttaaagaaatttaataaattcttattgtctgtttgnaatattcaacaatttaggctgggtgcggtggcccatgcctgtaatcccagtactttgggaggccaaaagagggtgggtcacctgaggtcaggagttagagagcagcctgaccaacatagtgaaaccatgtctctactaaaaatacaagaattagccaggcatggtggtgcatgcctgtaatcccagctactcgggaggctgaggcaggacaatcgctcctgggttcacgccattctcctgcctcagcctcctgagtagctgggactacaggcgcccaccaccatgtccggctaatttttttgtatttttagtagagacagggtttcaccgtgttngccgggatggtctcgatctcctgacctcgtgatcaacccccctcagcctcccaaagtgctgggattacaggcataagccatcgtgcctggcccaccataggaatttatatactgacatatatataagatttttagctcagttctttttatgatacagttaccttatatgnccacttantgaaatactatatggctattcacagtgatggctatgcagattatgtaatagaatagaaaatttatgcctatagtggtataagtgaaaaacataagctacacagttataataactaggtagaaaaacgcatagaaccaaaaagactggaagaaagaacaattagctttcaggtgccatttaccaattgttgggcatcttttttttaaaaatgatttattgtcaggcatcttttagcccaggtatcaaaatataaaattgaccaaggacttagtgtacatcctatatgtatatatatttttaatcgatttctatgcagatgtttctgcacacctgtccgtgatttgtccctccttcccacttgataactgtgtggcccacagaattctttgaccatagtgattggacttcagagtgaagaagtccagttgcttgtcagtaccttagtagtattaccagaatacccagtttttgctagggtatcatatgatgcaggagggcagttactagtaatgtttcttaggtaaattctttgagctgagagacaagttagagaattccctttggagatcaattaaatttaggcttagaaaagtagaagaaacagactttattacccattaagagttctctgagctaatcagtctggttaacaagttatagagatatgctagagggaatgtctcttgaagtccagggtagagttatggaccaagttgggagcagctaccgaggtcagtctgggaaggtaagctaaacagctaggctggttcactgcctgccagagatgtggttgaggatcaccatccacgttaacagggtgcatttcaagaaagtgaaagtgccactttgaattgctgctctttgacacatgtcaaagttcaggagaagggacatgctgtgcgtaggacatggggaagatagcagttgtaccaagaatgaatggaagaggaaggggagcaggaaaccttgactattcccccaggtgagaaagtggaattaggtcattgatacttggctggatctgccgggcccttactgaccctttgcccttcaacaggtgaccctgcccttagcatgagccactggatgttccatcagcaggccctgcaggagtacatcctgatgtgctgccagtgccctgcgggggggcttctggataaacctggcaagtgagtgttttctctctggggagggaggggagaggggaggagagagcagaggggcgtgcacctcaggcctactcagagccagatctcaagagcagaggtgtcaccttcagcacctgcatagcgctaggttgtatgggaaaaagcacccagttgggagcaccccttgaggccattgatcctggcacctccagctgcccgtcttgtcccccagcctgcatgcaaccccctcccccagacagggaaacagattgctgggtagataactcttctttttttt

SEQ ID NO: 370195 - DNA, 1281 bp, Homo sapiens
agttatcaccctataatcgtatctgctttcatcttgttgtgattatgtgtgctggtgtccaaattcaggatatctggaagctccttgtagagcttttgaactttgagcttctatgctttaataatataggaagtcactgaaacagtctatagttttttatataataaacatagcgttttcttttcagactctaattttagccacaggttatcatttaccttataataatagtcttttatttgttataggatatgaaatatatgtacattttgtacagatgtgtaatgcagtttcctaaagtttaataaatatgcttttttaaataatagctttgttgagatataattcccataccacacaacttacctattcagttgcgaaccatcatgacaattttagaacattttcatcactcatccccccaaaaatccccatacacattaaatattttcttaaaaaggaaatcgtgaaggaaaaatcaatagtatgattacaatattaagtataaaacatatatatgttttacattaattaaattttaaaaattttaaaaagttttaaactcacataaccaaaacagaggagcaaaaaggagaaaatagatgcagcatatgatgtagacaaggggcaagtataagaaaaagctagattaataaaattggctattggatctcagaagattaggccaaacagacaccatcataaggaaatgcaaatattaaacacaagttatggaaaaatttcaccctaattagtaatcagaggcatgcaaatcaaaataaactatcaggtactatttctttttaccattttaattgctgataacttttaaaaagtaactaaagctggccgggcgtggtggctcacgcctgtaatcctagcactttgggaagccgagttgggcagatcattttaggagttcgagactggcttgatcaacatagtgaaaccctgtctctactaaaaatgcaaaaatttagccaggcgtgggggcttgtacctgtaatccaaggtactcaggaggctgagacaggagaatgacttgaacctgggaggcagaggttgcagtgagccgagatcgtgccattgccctccaacctgggcaacagagtgagactctgtctcaaaaaagaaaaaaaaaaaggaaatattcaacagtttaatattttgcttcaatctctttatagactgtatcataaacttttcatttttatttttagaaatcttttcccccgtttttcttttttgctattttctccaaaatgggaaaggttattgata

SEQ ID NO: 370196 - DNA, 397 bp, Homo sapiens
gcaaaagtagaagaaaagatccaagaggtcttcagttcttacaagttcaaccaccttgtaccaaggtaagctgtggttaggagtttgaggggatctgggagaacaccaccatgcagcagcctttcttctttcctccttgagcgaatctaaccacggggagcatctgctgcaagaatggtgtttcttgtccttgtggttacctggatatgctaagacccccactcctccctctggtagaatactgtttagagcgattctccactcgagctgagctgccaggtgttacatggggattcccctcaatgcctcaattctgaggtctgaagatggagagaggaattccaggtttttgtttagtggtggcctgctgctctggtcttcagatgagaactctcag

SEQ ID NO: 370197 - DNA, 750 bp, Homo sapiens
cgcggtgcctttcggctctgggaagctccgggcgcccaggcttgggcttcgtcgtggagcgtttgcgcggccagcttggggaagggtcgtttcaaggttgggcttggaggagagggcagtagccgagtcccctctgccctaaagaacgagaagaatcgtgttctatgcctggaggacagaggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggtttgggggcccgcctcgtgggtgggcatttcggtagtcattcagccatttgagcaccagctacgtgtcggacacaatattaaacgatggaagtacaaggaaataaaacagctcctgaccaggagcctggttgggggacaggcaggaaaacagtttggaaagtgatctaatagaaagaatggattttggactactaatcattccctaaggcctagaagtaggatcgaacctatcattttgaaaagtgtttggcgaatgagtatatattcatatgcccaaaaccatagttttgtttttcttcttattccctaattggaattgttcccaaggttgctatgtggaactgtttatccatctgtccctaggagaagtggttaggataattcttaacactaataa

SEQ ID NO: 370198 - DNA, 3137 bp, Homo sapiens
caggactctacgctcttgcagcagctcctctgcccaatggggggcggcagcatctcagtaactcactcgaaagacgggtaggcgggaggagacattcgcgttcaaaatctttttgcctctatccgctcgccgtagcgctttagcccgctcgagtttcaatgcgcgttgttgcttaacgaagcagagtcctacacactgtctgctgctctcctgatcatggcttctccgagttctttcacctactattgccctccatcttcctcccccgtctggtcagagccgctgtacagtctgaggcccgagcacgcgcgagagcggttgcaggacgactcggtggaaacagtcacgtccatagaacaggcaaaagtagaagaaaagatccaagaggtcttcagttcttacaagttcaaccaccttgtaccaaggcttgttttgcagagggagaagcacttccattatctgaaaagaggccttcgacaactgacagatgcctatgagtgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttctaaaaaacaacaaacacgtgtcacggcagagaatagaacttggttcgggcgccttcgggcctagaaaaagcttttctaaaccctgtcgtgtgggggcgcgggccgcgcggtatgttggaacgtgggccaatgccggttccaagaaaaccgggcaagagcatagggctgggttcccccccattaaaaaagccggcggccccgccgcgtggaaacaacccgagggcgtcggacgcctgcgcgctctccccggcgcagcgagccgataatcg

SEQ ID NO: 370199 - DNA, 2420 bp, Homo sapiens
gtgattgtgaataagggatgttttctctcctgtctctctcccagtgtctgtctggatgccagccgcccatggctctgctattggatcctgcacagcttggaactgctagatgaacccatcccccagatagtggctacagatgtgtgtcagttcctggagctgtgtcagagcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370200 - DNA, 2567 bp, Homo sapiens
caagaggtcttcagctgcttacaagttcatgcacgcgttggtagcgtggcttgtgtgagcgatgcagggagaagcacgtatccactatatctgacaaagaggccgttctgacaaatcgtgtaccagtatgccgtaataggaggatgtcgtgcgatgccaagggctgcccgagtggcatcgtagtcgtgattgcgatccatgccacgagcagtgtggaacgctgctatacgatgaaacccaatctcccgccatggataagtgtgctatccagagtagatcgtcgctcgagctctcctaggaagctggtggtcaagagtcccagaaggtggctttggaggaggacccggtcagtatccacaccttgcacccacatatgcagcagtcaatgcattgtgcatcattggcaccgaggaggcctatgacatcattaacagagagaagcttcttcagtatttgtactccctgaagcaacctgacggctcctttctcatgcatgtcggaggtgaggtggatgtgagaagcgcatactgtgctgcctccgtagcctcgctgaccaacatcatcactccagacctctttgagggcactgctgaatggatagcaaggtgtcagaactgggaaggtggcattggcggggtaccagggatggaagcccatggtggctataccttctgtggcctggccgcgctggtaatcctcaagagggaacgttccttgaacttgaagagcttattacaatgggtgacaagccggcagatgcgatttgaaggaggatttcagggccgctgcaacaagctggtggatggctgctactccttctggcaggcggggctcctgcccctgctccaccgcgcactgcacgcccaaggtgaccctgcccttagcatgagccactggatgttccatcagcaggccctgcaggagtacatcctgatgtgctgccagtgccctgcgggggggcttctggataaacctggcaagtcgcgtgatttctaccacacctgctactgcctgagcggcctgtccatagcccagcacttcggcagcggagccatgttgcatgatgtggtcctgggtgtgcccgaaaacgctctgcagcccactcacccagtgtacaacattggaccagacaaggtgatccaggccactacatactttctacagaagccagtcccaggttttgaggagcttaaggatgagacatcggcagagcctgcaaccgactagaggacctgggtcccggcagctctttgctcacccatctccccagtcagacaaggtttatacgtttcaatacatactgcattctgtgctacacaagccttagcctcagtggagctgtggttctcttggtactttcttgtcaaacaaaaccaatggctctgggtttggagaacacagtggctggttttaaaaattctttccacacctgtcaaaccaaaaatctatcagcccacgtggtgtggttggtgaacagtgcatgccaggaggaagcagtccctcctcaccagctctccagccaggacgatcacacagagatgaatggcatctgagtattacggcatccagagccactgctgactcccacttgcacgccaccattcagtcaccagactgggtgccctccgatgggtggaataagtctgcttcatgccaaggctgggctttgggtcccaccaagatgagttctctgtaagactgtggtggagttgcaccaggaggtgcctctgcctctcgacttgcaccctggtcatttgtaagggaaaagagctggaggtggggagagaaagatctccttcagttgggagtccttccacttcaacactggagaactgagccttgcatctctccagggtccaaggccacgcttggtgcacaggcaagacttgcttcagccccaggtgtggtgacttagacctaggaaaccaattatgagtggaaagtgaccctctagttcaactgtgccagaggaaacagccctccagtgcccacctgcctcactcctccctatcatgtaccgtgaaaaccccctctgatggcctcaaggcagtgcctgcaggccgaggcccttctgggggtttctatctttcttccaccagactccaagcccactctcctccaagactgtgttgtcttttctcaccaagagtattaacactactaagtctttcaccttaacttatgactcaggatttattcacgtcctgcccactctaggctcacaggaataaaatcaagtgctagacacactggctgctactaaggcactagcctctgtagctggtggtggcagcgtggggtgccgcccagcgtgctgggtcctggcagtgcctctgctgtgctgcacattgagccctttctcagtcagtggagtatcaagttgggccatctgtctactgacctggccttcatgtaagcagctgtgggctgcgggcagacaggagctcagagatgcagcatgaggcgcttagaaaaacctggccatttgctgcctctaattcccttttgctttgccatattgggctatgtattacctccttgaaataataaaagaataacattttcta

SEQ ID NO: 370201 - DNA, 2535 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggtgagtgagacatccttccttccaagaatccctgccccaggtcagtgtgggaagggtaggtttcccctaattcaaggatgtttggtcaagtttctgagcagttctttgttggctatctctcaatatccaaccagatctccccaacacttgctggtacttttgttcgggtgcccccatcccctactatttgtttaggctagggaactgggggctgtatccctgcaggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctg

SEQ ID NO: 370202 - DNA, 2076 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370203 - DNA, 2405 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgatgtgcgtcctgataggagagaaatgacaaatgatgggggaggggggagaggctgtgtggtacaagcaccaactgatatatggtggatgagcctatatagagcttaggctgcaaaaatgtggccacttattcatgggctgagaaagaagagaatttggagaaagtacctacatcctggtatgcccccagacttagaatccccagatctctttcatgttttctccttgtcctacagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370204 - DNA, 2630 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgatgtgcgtcctgataggagagaaatgacaaatgatgggggaggggggagaggctgtgtggtacaagcaccaactgatatatggtggatgagcctatatagagcttaggctgcaaaaatgtggccacttattcatgggctgagaaagaagagaatttggagaaagtacctacatcctggtatgcccccagacttagaatccccagatctctttcatgttttctccttgtcctacagtttggaaactctggaggtcccctggttaacctggtgagtgagacatccttccttccaagaatccctgccccaggtcagtgtgggaagggtaggtttcccctaattcaaggatgtttggtcaagtttctgagcagttctttgttggctatctctcaatatccaaccagatctccccaacacttgctggtacttttgttcgggtgcccccatcccctactatttgtttaggctagggaactgggggctgtatccctgcaggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370205 - DNA, 1781 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370206 - DNA, 1612 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggtgagtgagacatccttccttccaagaatccctgccccaggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370207 - DNA, 300 bp, Homo sapiens
acaccatgaaggtcacagctggaatctcctttgccatcccttctgatcgtcttcgagagtttctgcatcgtggggaaaagaagagtgagcctgccttatggggaaacgggttcctttaatgtggtggaaataggggaagggcattcagtgggacttcctggagggtggtctactgggagaagagggcagggaaggaaggatgtagctgggtggggctcatttgtccctctgtcacagattcctcctccggaatcagtgggtcccagcggcgctacattggggtgatgatgctgaccctga

SEQ ID NO: 370208 - DNA, 234 bp, Homo sapiens
ggccaggtctggttggagctgcttatttgctcgcatcttcagatgacaggtctcttttacccattctcccttaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaacca

SEQ ID NO: 370209 - DNA, 2172 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370210 - DNA, 2342 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgc

SEQ ID NO: 370211 - DNA, 2106 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggctagggaactgggggctgtatccctgcaggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370212 - DNA, 2288 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctgccatcttttgtgggcagttagtcaggtgctgc

SEQ ID NO: 370213 - DNA, 1632 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcagcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgattttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagcatccttgctgaactacagcttcgagaaccaagctttcccgatgttcagcatggtgtactcatccataaagtcatcctgggctcccctgcacaccgggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370214 - DNA, 1881 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaagtttggaaactctggaggtcccctggttaacctggatggggaggtgattggagtgaacaccatgaaggtcacagctggaatctcctttgccatcccttctgatcgtcttcgagagtttctgcatcgtggggaaaagaagaattcctcctccggaatcagtgggtcccagcggcgctacattggggtgatgatgctgaccctgagtcccagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacat

SEQ ID NO: 370215 - DNA, 397 bp, Homo sapiens
tacaccttatgtaaacaagtgaaatgtatctgctataatttttcttttcagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacagggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctga

SEQ ID NO: 370216 - DNA, 308 bp, Homo sapiens
cttgaaggtgaccctctgaattctagttgtcttgaccttgttggactcccagcttcatcccctcaactcaggaatactgtccagctctattttggtttctcctttcttcactgcaacctggaagttgtctctaggtgggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctga

SEQ ID NO: 370217 - DNA, 3795 bp, Homo sapiens
  misc_feature (3665)..(3665): n is a, c, g, or t
  misc_feature (3668)..(3668): n is a, c, g, or t
  misc_feature (3672)..(3673): n is a, c, g, or t
gcgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagctaaaattaattataaaataaaaacagtgaccagtctagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaataaaaacagtgaatgggtgtaggtgtgatggaattcactttacttactaaatggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacagaagaaacttcctctttcaattctagtagttgaagaatttatatttccaaattgtatgattataccgctactttttgatacatcaattatttattgacttcctactagaaagagtgaaattttgcccatttatactgcaccatttttccagtatatgaatattttactctttgtacatcagaaactcagtattttcattattatgactagagtttttttgtttgtttgtttgagttctacttgtccaataaggatgatgattttcttttagatgtaaatgttaacttcaatagcaagaattcaaaaataatattctctttgagattgactgtgaatgttattgaaaagtgtctaaattagtctgaggatcaatgagggtcaattcagttaggaattgaataatgaaacgtgtctctctgaattcccccggcaattgttttagtcatttatcaggccaaaattaaaatgtttttgtactacaagatggaagtataaaattattggacaagtgaaatcgtatcagtagttcctgactgacagcttctggagccacactagagcagtgattctcagtctaacattaggttatcatgatgacgtatgagtaaattcttaatggttaaatgtgagacagttcacatttattcccatagaaatgtcattctcatttgaattcagagatacttctttgctggaagttggaattatagctttacaccaaggagtgacacgtagactaatctggcaagccaaggtagtgtttggattgcaatgtcatgattctattttaaattcttgatggtagaaacatttttaataaggaaggtaaaaatactggaaaaaagtgaatagtgtaggttttgtgaggaaagttaacatttgtcaatgacaagcattaaggccacctaataaagtgtagacaaagtgataaatgaaatatacactgatgatactcatttcaatatgctaaaatacattaaatttaggtattactcttaatctatttctacttagtcagtgctatctgattacctgttaatagcatctgaactggagagctggaaaaatccacttttttatgaagcagtaattatagaagtactaaaaattacaatgtattagtaagtttaatattttgacagggcatggtggctcacacctgtaatcccagcactttgggaggccgaggctggcagatcacaaaattaagagatcaagaccatcctggccaacatggtgaaaccctgtctgtactaaaaatacaaaaattagctgggtgtggtggtgtgcgcctgtagtcccagctactcgggaggctgaggcaggagaatcgcttgaacccaggaggcggaggttgcagtgagccaagatcatgccactgcactccagcctggtgagagagtgaaaccccgtctcaaaaataaataaataaataagtttactattttaaaactggttaatcatttatgtattttgccagtaaaattactttaaaagatattttaacaaaagtctcatatccttgtacttcagtttttttgtgtgtgaatactatccctataccactacccctaaaacctcagaattatttgctttattttttcatacaacttggggaagggaaccatgggagtatgcacatgggatcataatccattctgtggtttggaaaaagaaaatgttaacctctgctttagagggtagctactagctttgttggggataaaagtgtaatacatgcacttttgaactctgaaagtttgccaatctgaaaaggggtgtttctgaagaccactatcttttacgaacacttaaaaataagtgtttgcagttgtgtatgggcacgatactgtattctttacatttttatggccctacagctacttcttatccctgcaagtatataaattaaaaccaagtcactttagaacagctttgaaactagagtttcaaaggtaaaaggatctcatgtttctgaatctgcgtaaagcaagatggctgtgatttgacaggtttaattgctagttttttataggtggatagaaatgaatagtttggagtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcatgagttttgcggncantaannattttccaaaaaaaaagggggggctaaaacccaggccatacgtcccgttggaaagggccaagagataaagaagggtaaggaggaagaggctcgaacctgggagcccaacggaaaagacgcga

SEQ ID NO: 370218 - DNA, 1571 bp, Homo sapiens
aggaaagcacaccactccagtcaaaaccttggtaaaataaccagtttctccaattgtgccctgttacaaatgaaaacagatttttattgcacttatgcaaataactattgccgtaagttaagatactcactaataattttcaagttctggagaaatcaggtagagagaaacaattatgctccaaattttgtttataggagtatactttgcttaattgttaaaagctgtcaatagctccaaaaaaaaaaagtttccttgactctggaaagcggaggttgcagtgagccaagatcatgccactgcactccagcctggtgagagagtgaaaccccgtctcaaaaataaataaataaataagtttactattttaaaactggttaatcatttatgtattttgccagtaaaattactttaaaagatattttaacaaaagtctcatatccttgtacttcagtttttttgtgtgtgaatactatccctataccactacccctaaaacctcagaattatttgctttattttttcatacaacttggggaagggaaccatgggagtatgcacatgggatcataatccattctgtggtttggaaaaagaaaatgttaacctctgctttagagggtagctactagctttgttggggataaaagtgtaatacatgcacttttgaactctgaaagtttgccaatctgaaaaggggtgtttctgaagaccactatcttttacgaacacttaaaaataagtgtttgcagttgtgtatgggcacgatactgtattctttacatttttatggccctacagctacttcttatccctgcaagtatataaattaaaaccaagtcactttagaacagctttgaaactagagtttcaaaggtaaaaggatctcatgtttctgaatctgcgtaaagcaagatggctgtgatttgacaggtttaattgctagttttttataggtggatagaaatgaatagtttggagtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcattgatgtattttgccggtaaaattaaaagatattttaacaaaaaaaaaaaaaaaaaaaaaaaaaaaaattgtgtgtggggcgcactgcgggcccgcgagaaaaagagtatttattacaaaacacttggcggtgtgggcgcgcgcgggggcgaccgccaagtgagtggttagtgtggaaccgttggccaacaaccgttgtctcccaaagagaaaaccggggccgaggaacaggctgcgcgggatttcctcccacaaattaagaaagcgccgcggggggacacccggaggcgttctggaacaaacttcccaaaggagaggtcggaagggcacacaccgggggcctataccaagaggatcccacgggagcagaatataaattagcgcgccgtggaggaccacga

SEQ ID NO: 370219 - DNA, 462 bp, Homo sapiens
gcgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataaaaatgacccccaaaaagctga

SEQ ID NO: 370220 - DNA, 967 bp, Homo sapiens
gcgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagct

SEQ ID NO: 370221 - DNA, 4053 bp, Homo sapiens
gcgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgtaccagatcctgctggacggcaccttctgtcaggcggcgctgcggggccgcatccagctgcgggagcagctgccccgctacctcatgggggagacgcagctgtgcaccacaagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagctaaaattaattataaaataaaaacagtgaccagtctagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaataaaaacagtgaatgggtgtaggtgtgatggaattcactttacttactaaatggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacagaagaaacttcctctttcaattctagtagttgaagaatttatatttccaaattgtatgattataccgctactttttgatacatcaattatttattgacttcctactagaaagagtgaaattttgcccatttatactgcaccatttttccagtatatgaatattttactctttgtacatcagaaactcagtattttcattattatgactagagtttttttgtttgtttgtttgagttctacttgtccaataaggatgatgattttcttttagatgtaaatgttaacttcaatagcaagaattcaaaaataatattctctttgagattgactgtgaatgttattgaaaagtgtctaaattagtctgaggatcaatgagggtcaattcagttaggaattgaataatgaaacgtgtctctctgaattcccccggcaattgttttagtcatttatcaggccaaaattaaaatgtttttgtactacaagatggaagtataaaattattggacaagtgaaatcgtatcagtagttcctgactgacagcttctggagccacactagagcagtgattctcagtctaacattaggttatcatgatgacgtatgagtaaattcttaatggttaaatgtgagacagttcacatttattcccatagaaatgtcattctcatttgaattcagagatacttctttgctggaagttggaattatagctttacaccaaggagtgacacgtagactaatctggcaagccaaggtagtgtttggattgcaatgtcatgattctattttaaattcttgatggtagaaacatttttaataaggaaggtaaaaatactggaaaaaagtgaatagtgtaggttttgtgaggaaagttaacatttgtcaatgacaagcattaaggccacctaataaagtgtagacaaagtgataaatgaaatatacactgatgatactcatttcaatatgctaaaatacattaaatttaggtattactcttaatctatttctacttagtcagtgctatctgattacctgttaatagcatctgaactggagagctggaaaaatccacttttttatgaagcagtaattatagaagtactaaaaattacaatgtattagtaagtttaatattttgacagggcatggtggctcacacctgtaatcccagcactttgggaggccgaggctggcagatcacaaaattaagagatcaagaccatcctggccaacatggtgaaaccctgtctgtactaaaaatacaaaaattagctgggtgtggtggtgtgcgcctgtagtcccagctactcgggaggctgaggcaggagaatcgcttgaacccaggaggcggaggttgcagtgagccaagatcatgccactgcactccagcctggtgagagagtgaaaccccgtctcaaaaataaataaataaataagtttactattttaaaactggttaatcatttatgtattttgccagtaaaattactttaaaagatattttaacaaaagtctcatatccttgtacttcagtttttttgtgtgtgaatactatccctataccactacccctaaaacctcagaattatttgctttattttttcatacaacttggggaagggaaccatgggagtatgcacatgggatcataatccattctgtggtttggaaaaagaaaatgttaacctctgctttagagggtagctactagctttgttggggataaaagtgtaatacatgcacttttgaactctgaaagtttgccaatctgaaaaggggtgtttctgaagaccactatcttttacgaacacttaaaaataagtgtttgcagttgtgtatgggcacgatactgtattctttacatttttatggccctacagctacttcttatccctgcaagtatataaattaaaaccaagtcactttagaacagctttgaaactagagtttcaaaggtaaaaggatctcatgtttctgaatctgcgtaaagcaagatggctgtgatttgacaggtttaattgctagttttttataggtggatagaaatgaatagtttggagtctttaaaatgttttaaaaaatgtttgcttactatctatatatatgacattattcccaattagttttatatctccaagatatatatatgtatataggtatatacacatatgtatatatacatagtctatatattctatataagaatatattccaataagaatatattccatacgggaatatattagtcattgatgtattttgccggtaaaattaaaagatattttaacaaaaaaaaaaaaaaaaaaaaaaaaaaaaattgtgtgtggggcgcactgcgggcccgcgagaaaaagagtatttattacaaaacacttggcggtgtgggcgcgcgcgggggcgaccgccaagtgagtggttagtgtggaaccgttggccaacaaccgttgtctcccaaagagaaaaccggggccgaggaacaggctgcgcgggatttcctcccacaaattaagaaagcgccgcggggggacacccggaggcgttctggaacaaacttcccaaaggagaggtcggaagggcacacaccgggggcctataccaagaggatcccacgggagcagaatataaattagcgcgccgtggaggaccacga

SEQ ID NO: 370222 - DNA, 564 bp, Homo sapiens
cagtccagaaaggcattcagaagatttgagccttaaattattccaagatacagaaggcagacttgctttgctgaattgacattttaatcagtatttccttatttattttttaacaaggcaactatattatttataatatcctgccaaacatgaatgcatgcctttcacctgtgtaaggggctcaaggatggattcttggctgaagaattcctctggaaatatttcccaggccaaaggtgggaaaataggctgccagtaattggaagttttatgaagtatgcattaagattttatttattaatagtctcaagatttagccttatctttccaattttctttgataggtaaaatcagtagcctttctgctaccctttagggtgttaaagcagtgagttgtgttgggggttatttttcaacccagggtccatgttttttcacccacatgatttttaattacttcacttccagttaaagaatggtatgaaagtactgtttatatgtcttgttaaaataaaaacttagacaaattaaatttaacagagtttaattgagccaggaaaaaaa

SEQ ID NO: 370223 - DNA, 801 bp, Homo sapiens
cctttaaacttgagaaaagtaaggtttagctggtaaatccagtcttagtgacctctcatggagtgcatgattcactactattacaagctaagactatgaggcttagtgaccattacatctaattacttaccgtcatcaagttcacccttccatttttttaaaggtctggtgaataatcaaggttttaatacaagatgacccttttgaaaacccagaagtcttacatgcatgctttatgaatataaggtaaaaagttttactccttagcaggcggcctacaggaaatcaaatcaccattcatttagaagcaagatgatctctcatttaaacatgtacttctgtcctttttccaccatctttccatgccaccataatggtgctcatgattggtcctggctgatgctctcaagagcaataacaatgctaaaaagagaggcaaacatcaggttcttatggggccgtgctccagagccatcatctggtttctcactgtgatgatgaagcgtggttacactggcaaatttgaaatcattgatgattacacagctgggaaaagagctgcgaatccctcaggcaggttaaacatgtgtggcatgattagcctcaacttcgatgtacaactcaaagacctagaaaaatggcaaaacagtctgctcttctccagtcagtttagttgtattgacaacctcagctggcatcatggaccacaaaggagcaagatgaaagtgcacagtagggaaaatcctggggattatttttctagggatgtaatgcttacaaataaaatgctcaatagacaat

SEQ ID NO: 370224 - DNA, 1668 bp, Homo sapiens
agtgatccgggagctcagagtgtagttttgctaaaatagccttctcattggctgcggctttggaggtggcagaaatcatacgtttaatcacggcgccctcctgcttgccaagctttgcgtcctccagaattgtcctgtgagtgactcccgcaggatggagacttttgtgtctggcttccttcacttcgcagcaggcttcgcgggacccgtgtggtggcaccagcgtccagcccttggtactgctgagttgtaggttgtgggacaggtggaggtaccacagttgctcacgggttcacctgtggatgggcatgtgggctgttgtgagtgaagccacttcagacgtttgcgtgcaggtttggtggggacgtgcagtttcatttcttttgagagtgggattgctggagcctatgttaagggtacgttcaactcatcagctcaactgtcttccaaatggcagccccgttttccacccccgccagcaacgcccgcgactccaggcgcgctgcattttcatcagcacctggcagtggtgattcataatgctttaaatgttaatttccctcatgactagtgatgttaaacatcttattaaacatcttaggtattaattcatgtgttatttcaaatcttttacctactttttagtggattatatttgtcttcttagtattgagttctaagagttaaatattgtgggtacaagtcctctatcagaaatgtgttttgtaaatactttcttctagtctgtggtttgtctcttcgttttcttaagtatgtctttaaagagcagaggcttttgatttggataaagttcagcttgtcagttttttcttttagggttatgtttttgtatcctatctaagaatctttgactatcaaattctcacaaagcagttttttgttttcttctagatgttttacggttttaaattttacctttaggtctacaaccattgtgatttagattttgtatttaatgtaaggtataagttgagattcatttctctctgtttttggagacttatgtccagctattccagaaccatttgttggaaagagtatctttatcccaacaagttatgtgggcactttgttgaaaaagatctattgaccatatatacatgcgtttatttccaagactctattttgttctgttgaccgacttgtttgtccttatgacaatatcacactgttttgattacagtggcattattgtacctcttgcaaaaatcaagtgtgaatcttccaaagaagatttggaagattttctctttcaaagttgtgtgagttatttaagtgccttttcattttcatataagtttagaattagcttgcagtttctaaaagaaaaaaaaaaaaaggctgatgagactttgattgtgattccattggatctatagctcagtttgcagggatttacatcttaacaatactgagtcctcaaatccatgaacatggtacatctctccatttatttaggtcttcttgtattttttctcatcaacatcttatagttttaagtaaacaaattttgcacatattttgtaagatttatcattaagtatttcatgtttgtgatgttatggtgaatattgtttttaaattcaatttcctattgtccactgctagtatacggaaatacaattggttttcatacattaaccttat

SEQ ID NO: 370225 - DNA, 2033 bp, Homo sapiens
ttctgcccgcctcaaagtgccggagactccggacctctgcgttcctccttcccggtaggaacagaaagctgggaaagggctggggtggcaaggaagagccccaggaagacgggagtggctctccccactccctagaggacctccctcccccaagcccatgggccgccttctccagggactcttccctgtcccacccaccgggcaaggtgggcccagcagggtctccttttcaccgtgcgccccctcctgtggccgggtcctgggctaatgacctcacatgctgcttttacaagtcaggtttattgcggtatcacgtacacacataaggctcacccgttttcgatgtacagccgacgacttggtaagggtctagagtggggcacttctgccccgacagaggcagcccacattttgcccctctgcagtcaggccccttcccggcccccaaccaccacctgtctctcctcgctcctacagctttgcgtcctccagaattgtcctgtgagtgactcccgcaggatggagacttttgtgtctggcttccttcacttcgcagcaggcttcgcgggacccgtgtggtggcaccagcgtccagcccttggtactgctgagttgtaggttgtgggacaggtggaggtaccacagttgctcacgggttcacctgtggatgggcatgtgggctgttgtgagtgaagccacttcagacgtttgcgtgcaggtttggtggggacgtgcagtttcatttcttttgagagtgggattgctggagcctatgttaagggtacgttcaactcatcagctcaactgtcttccaaatggcagccccgttttccacccccgccagcaacgcccgcgactccaggcgcgctgcattttcatcagcacctggcagtggtgattcataatgctttaaatgttaatttccctcatgactagtgatgttaaacatcttattaaacatcttaggtattaattcatgtgttatttcaaatcttttacctactttttagtggattatatttgtcttcttagtattgagttctaagagttaaatattgtgggtacaagtcctctatcagaaatgtgttttgtaaatactttcttctagtctgtggtttgtctcttcgttttcttaagtatgtctttaaagagcagaggcttttgatttggataaagttcagcttgtcagttttttcttttagggttatgtttttgtatcctatctaagaatctttgactatcaaattctcacaaagcagttttttgttttcttctagatgttttacggttttaaattttacctttaggtctacaaccattgtgatttagattttgtatttaatgtaaggtataagttgagattcatttctctctgtttttggagacttatgtccagctattccagaaccatttgttggaaagagtatctttatcccaacaagttatgtgggcactttgttgaaaaagatctattgaccatatatacatgcgtttatttccaagactctattttgttctgttgaccgacttgtttgtccttatgacaatatcacactgttttgattacagtggcattattgtacctcttgcaaaaatcaagtgtgaatcttccaaagaagatttggaagattttctctttcaaagttgtgtgagttatttaagtgccttttcattttcatataagtttagaattagcttgcagtttctaaaagaaaaaaaaaaaaaggctgatgagactttgattgtgattccattggatctatagctcagtttgcagggatttacatcttaacaatactgagtcctcaaatccatgaacatggtacatctctccatttatttaggtcttcttgtattttttctcatcaacatcttatagttttaagtaaacaaattttgcacatattttgtaagatttatcattaagtatttcatgtttgtgatgttatggtgaatattgtttttaaattcaatttcctattgtccactgctagtatacggaaatacaattggttttcatacattaaccttat

SEQ ID NO: 370226 - DNA, 262 bp, Homo sapiens
aaatagttttaggcctgaatcttgaggctgggaccttgaatctgctgattatatgctcctcttaatgcatctctatttctaagtaacttggttttatagcaaagtaatatatgaatgcagtttctaaaacttaagtggtgctaaagatgttttaaaaagaaaaagaagcaggagccaggcatactggttcacgcctgtaattccagcagcttgggagactgagccagaaggatcatttgaggacaggagtttgagaccagcc

SEQ ID NO: 370227 - DNA, 146 bp, Homo sapiens
caaatcttaggaggctccagaatatagaagactacatgaacgtgtatctatatttactgtctaatgtttccacaaaagcagggaaaaaatcatgaaaatggtagtgggttaaataagacctctaaattgcacacttatttccataa

SEQ ID NO: 370228 - DNA, 662 bp, Homo sapiens
aagtttttaagcatggtatctagacaaggcaactcacatgacaataagacacaaaactttctcactcaagatagcaggtttggtttggtttgatttttaactcaagtttgatagtgtgaccaacatcatgttaggccttgtgagagacagaagttgggaagaaacaccccccacccccctccacacacacacggacacacacggtccctgccctcaaggacttccagtctagtaagtaagtggcaacagctacagtacaatccaggtcagcgaaaaatggagcctaaaacagagcaaagaaagacgcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaa

SEQ ID NO: 370229 - DNA, 3227 bp, Homo sapiens
agcagccagctccccagcaccgcgcggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtcgccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtggtcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaa

SEQ ID NO: 370230 - DNA, 270 bp, Homo sapiens
  misc_feature (25)..(25): n is a, c, g, or t
  misc_feature (31)..(31): n is a, c, g, or t
aacgtggccgagcctgcgaaagganatcatntgctcaaccttagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaa

SEQ ID NO: 370231 - DNA, 740 bp, Homo sapiens
ctgtgtgggacgtgcctgctttgccttcgccttccaccatgatctctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaggacacatcattttgcgaaaaaccatagtgaatgcagggttgcggctc

SEQ ID NO: 370232 - DNA, 1948 bp, Homo sapiens
agcagccagctccccagcaccgcgcggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtcgccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatgggttgtacctcacgccacgggatcctctagattcatcc

SEQ ID NO: 370233 - DNA, 516 bp, Homo sapiens
aattggggttaacaccttatttattattatctaaattccataaacaaattacagacaattcttaagaggctcctgccacaaaataactcctttaccatgtaggaaaagagcctttcgttttctcagctgtcttggtgacaatgccagcattttcctaggctactggctacttacatattcactttagtcaaaaagatagggctggcaggctttaggaaaaaatgtgatcctacaaaattatgtaagatgtcagagggtccaagtatacaggactacttgattatgaaaattgcgtgagtaggcaagcacattggcttttgaacagtgtcagcaatctgtggtatgaatgtgatttcttccaggacttcttggaagagctgaagctggtggtgagaggctcactgttccaggtggccagcctgcaagactgcttcctgcagcagagtgagccactggctgccacaggcacaggtgtgggctcttgggcagtttgcatgccttcatcaacacaaactc

SEQ ID NO: 370234 - DNA, 535 bp, Homo sapiens
caacgggacaaggatggtgatggtgtgggggatgcctgtgacagttgtcctgatgtcagcaaccctaaccaggttagtaggatactggggaattcaaactccaggctgaattcctctatgcaaagactcatttaagacgggtgtctagaaaaacagcagagcctcttagctgttgccacttacctaacaaagcagaggtggaaaaatgacacactgtgggcctgaagatggtgggatgaacaccacacaagatctgaagccctagggactatctcccaggctgtcgattgcctgtgaggttagtaacacgaacttcatgatgctcaatacaagtatttttcctgcagaaaggaaaacggagcatggaaattaaccattgggagccttgtgtccctttagtccctaaacccctacacagcctatgtatggacatttcagattaagttcagccagggatgtgttgcatctcccttctcactcctcctccctgtctggataattgggtatgatgtgtcatttatttttaaagccctga

SEQ ID NO: 370235 - DNA, 2528 bp, Homo sapiens
agcagccagctccccagcaccgcgcggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaaacaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtcgccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagcggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaa

SEQ ID NO: 370236 - DNA, 862 bp, Homo sapiens
gaatacagccatgggaaggtcttcagtccccctggaaccctgatggcaaaccacagagggaaggcacacagtgaagtcactgtgctatctgataccattgggacatgcagccccatgtttcccctggtgttgtgaaatgtgcccattaaagcttttgcaaagcatattaccctcgtggtcacatgcagaccaaataacaaagcggaagaaaagtgaagctgttgcggcagttctgcatccatgtgtgcttctgaacagaggaatcgtctgcacctttggccttgggctcacagtgcgttctttaggctgctgccattggcacttcctgttgttttgattcattcattaccagcaaataccatttttaggcacccttgacagcgacagacacagccatcctctctggaagcctctcaacccagaatggaaatggaggaggttccattaactttgcgctcagacgagtaacttcggcaaagggatggggagaggtaagaatgtctattggctgagttgtgttgtctgtgcaaagccttatttctgaacatttacactctcaaagctcaccctcaaactcaccctgggggccccgttgttgtgtaagaacggtaccaagtgtcaagcttccataagttgactggtcctaaaagaaaaataggtctcatgagcctggccaacatggtgaaaccccgtctctactaaaaatacaaaacttagctgggcatggtggcacctgcctgtaatcccagctacttgggaggctgaggcaggagaatcacgagaatcacatgaacccaggaggcagaggttgcagcgagtcaagatcgcgccgttgcactccagtctgggggacaagagcaaa

SEQ ID NO: 370237 - DNA, 3610 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370238 - DNA, 3582 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370239 - DNA, 3512 bp, Homo sapiens
acgaagattataggcggctcctggttgtatttatgaggggacggtgctatgatgtagatggctgtgtagtgagcagacaactggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370240 - DNA, 3320 bp, Homo sapiens
gaatacagccatgggaaggtcttcagtccccctggaaccctgatggcaaaccacagagggaaggcacacagtgaagtcactgtgctatctgataccattgggacatgcagccccatgtttcccctggtgttgtgaaatgtgcccattaaagcttttgcaaagcatattaccctcgtggtcacatgcagaccaaataacaaagcggaagaaaagtgaagctgttgcggcagttctgcatccatgtgtgcttctgaacagaggaatcgtctgcacctttggccttgggctcacagtgcgttctttaggctgctgccattggcacttcctgttgttttgattcattcattaccagcaaataccatttttaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370241 - DNA, 2815 bp, Homo sapiens
ggtcatggacgcctgggtccgcttcagtgctcagagccaagcccgggagcggctgtgtagctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370242 - DNA, 4400 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtgagtgctgccccaccgttcccaagcgagggctgtaggggacacactccagaccccacatgttggtctcagggccttagaggtcagacttctcttctccaacaacttggctctccacttagtctttattgtgggatgcgacactgggctctgcagtccctgccctgaagataattaccctccaaaggcctaacaagggcttttttaaagtggtgagtattggcctctttttcttccctctgagtgttctgccttttactgagcaggagggagcaggcttcctgggtatgtggcgagcatactgccaggtggccatgggccgtgtgcgcggcctggcgagcacatgcctgtctgagggggcggcacagctatgcccagcagaatggcaccacaggagaacacaggtcctttctcaagaggagctgggattccagcttctcctgtgaaatctctttatttttaaagctgacaacgcattgtttttttattgggtcaacaaatcccacccacgcattaatgatccctagaaagggagctcccaccggtggccaccggagggtcatgccgtttcaggtgcttctcaccttctgacccagagctgcctgccctaggtctaggagtttcagagtgagccactcgggtagcagagctgtcagggtgcccactcccttcctttccaggccctgagcaagtatgttgacgtggacaagactgcctgcctgtggccctctcaccagaggtggaacaggcctggcagggccctgactgtgtcatccttgttctctggcaggtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370243 - DNA, 2836 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaagtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370244 - DNA, 2234 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaac

SEQ ID NO: 370245 - DNA, 1815 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtgagtgctgccccaccgttcccaagcgagggctgtaggggacacactccagaccccacatgttggtctcagggccttagaggtcagacttctcttctccaacaacttggctctccacttagtctttattgtgggatgcgacactgggctctgcagtccctgccctgaagataattaccctccaaaggcctaacaagggcttttttaaagtggtccggctgatgcaggaatctgtccgaaggataattgaggcagaagagtccagaatgggcctcatcatcgtcaatgcctgtgaacccgacagattggcacatgaccacgagccagcaacccgcgagcaa

SEQ ID NO: 370246 - DNA, 1467 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtgcgttggcccaactgggccaacgcaccgtccagctcgtccctttccagttttacagtgaattgctgcgtgcgttggcccaacgttgggccaacgcaccgtcgactgttggaggaagatcttcagagatgaggggggcaaggccttcttcaagggtgcgtggtccaacgtcctgcggggcatggggggcgccttcgtgctggtcctgtacgacgagctcacgaaggtgatctcagggccgcggcctcctccacacacacacacacaccaggcgacacaagagaaccacgagaatcctaaacgtgcccgacaacgcg

SEQ ID NO: 370247 - DNA, 305 bp, Homo sapiens
aggagcataggctcagtgtcaccagagttttttatttcttgtgagaagctagaaaactgggttttcagtgaagtctcccactttttaattactggctgctaataaatcatggtgcactcactgcggctgccagaccgtgacccctgccttaaaggcctgtgtgcagcagatgcccagagctagtgggagggcagatacccatctccccacagagtcacacgccctagccacgcatccttgcaccctctgtctccccagctgggaatccctcactcctttgcactgatcagctatcagcacaaatt

SEQ ID NO: 370248 - DNA, 328 bp, Homo sapiens
cggctgaggggagtcgggaggttactaggaagattctggctaggaccctccccctctgtgtggatagaggcctgacctcctgcttttttttttactgggagctggcccagggatgcatagacgtgacagtaagtgaggtcttagccaggcagagaggaagtaacagaacagctgagagcaggtgctatccaggacctattctgtctctgtgtctctccagctttgtgacaacaaactgtgctctgcagttttcatcccgtggaatccgacccggcctgaccactgtcctagctcggaacctagacaagaacaccgtgggctacctgca

SEQ ID NO: 370249 - DNA, 3500 bp, Homo sapiens
  misc_feature (1)..(1): n is a, c, g, or t
naaaaatgagcatagaagaggccggcgtgttatatcggacgatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370250 - DNA, 3481 bp, Homo sapiens
  misc_feature (92)..(92): n is a, c, g, or t
aggtatttcagtacggggcctgggctttaattgaggtatagatggttgcctaggttatacacatatttactcgttgctgaacgtgcgcaggnaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370251 - DNA, 3536 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370252 - DNA, 3352 bp, Homo sapiens
ccactagcatagtcacgggctttacttctggagccagggtggtgtcaccttctccaggaccaagtggatttccacaaaccagtgtggggaggggtgtgaatggcaatcacatatactgatcattcaacccagaaacctgagcgtcgtctctgatttttccttctctactcttggcatcctgtaggttgaaatatcacagggttgattccgctttctaaatgtttctcagattgaatttttttcctttggatctcagtgaccacattccaggggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370253 - DNA, 3118 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaacaaacgggtttggaaattagtcgtcttttttccccactcccagagctgctcaaatcattccaccggccccctcggcttgggacagggtagtgtaactcccgatcccagggcctagccctgacacaggtggcttcccgtatcccggtgggaaaacgccctgccaccagcgggcttgagctggcctgtgtccctccactgcctgcaccacccacctccagagtgcagtgctgggcaagggcagctcaagaggacaggaccaggcgcttggcaagacatcagacacacccaacccaaaggcgtggaccccaggcccggcccgtggtacccagcaggtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcacaggcctctggagttggccaggcctctggagttgggcaggcctctggagttggg

SEQ ID NO: 370254 - DNA, 2390 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcgatggggtatccagtcagccatgaacactagcatcgtccgagacactaaaaccagccacttcactgtggccctgcagctgggaatccctcactcctttgcactgatcagctatcagcacaaattccaagatgacgatcagactcgtgtgaaaggatccctcaaagcaggcttctttgggacggtggtggagtacggagctgagaggaagatctccaggcacagcgttttgggtgcagctgtcagcgttggagttccacagggcgtttctctcaaagtcaagctcaacagggccagtcagacatacttcttccctattcacttgacggaccagcttctgcccagcgccatgttctatgccaccgtggggcctctagtggtctactttgccatgcaccgtctgatcatcaaaccatacctcagggctcagaaagagaaggaattggagaagcagagggaaagcgccgccaccgatgtgctgcagaagaagcaagaggcggagtccgctgtccggctgatgcaggaatctgtccgaaggataattgaggcagaagagtccagaatgggcctcatcatcgtcaatgcctggtacgggaagtttgtcaatgacaagagcaggaagagcgagaaggtgaaggtgattgacgtgactgtgcccctgcagtgcctggtgaaggactcgaagctcatcctcacggaggcctccaaggctgggctgcctggcttttatgacccgtgtgtgggggaagagaagaacctgaaagtgctctatcagttccggggcgtcctgcatcaggtgatggtgctggacagtgaggccctccggataccaaagcagtcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcctgctgaaatattactgcttgaatctggagcagattgcgggtttataaaactgctttttatctgagaac

SEQ ID NO: 370255 - DNA, 1852 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagagttggaatttggagctggagacctacaggggcctttgttcggtctcaagctgttccgtaatctcacaccaagatgctttgtgacaacaaactgtgctctgcagttttcatcccgtggaatccgacccggcctgaccactgtcctagctcggaacctagacaagaacaccgtgggctacctgcagtggcactgcagctccccgctcctgcaggtccagcgtcctcacaggaacaccagggcctgtgctccggagccttccttcagacccttcctccacgtgcccacttgggatgcagaatgcagcggagctaggaccccctccacggcctggacctcggctgcagtaaagttacgtgaggcctgtctctcggggcctggaagtggcagccatcagttgctcttgctgacccctcggagcaagcgccgcacaggtggtggctgagacagctggcgcggggggccccaagctgcgccggcctccagcccacccacagctgttgctgaagtcaggcctccctccccagcactggtatctgagtaacggctaagaacctccttcctctggttttgaaaagcagttcgggttgtccaattctgtaacattcatctccattttttaaaaaggtttctctgacggccccacggcccgagccgcggtgagcgtcgtgttgcatgagcctgggccccgggcttcccgtgcgcctctgccgcaggtgcttctgggcacccatcctctgcgtttcatttgcagtcgactgtacagaaggcactcaccacaataaacctttcctgaaagcaaaaagaatcggagcagaccacccaacggagcccgagccgccgcgcacgcacccaagaacgcgcgcatcggggccggcaagagacacggaggggccgacaggcgcacgccgcggttagcaagggcccacgaggggtgtaaagggcgggggcgaaaacggggggaagacagcgcgtacggagcacaagggggacggggcaccagcaagcggcaaacacaaggcaacccgcggctccgatagcgcacgaacggaacgaccgggcggctcaggacgag

SEQ ID NO: 370256 - DNA, 1152 bp, Homo sapiens
tgctggtacggcccggagttatgggatgacggctccgggccgccaggggccgctgtggcgcagccgggctggcccgcgctgtccctgacgcggatcactggcccctcttgagcacggccttgccggtttggcggggtgaaaggttgcgaagatggcgacggccttgagcgaggaggagctggacaatgaagactattactcgttgctgaacgtgcgcagggaggcctcttctgaagagctgaaagctgcctaccggaggctctgtatgctctaccatccagacaagcacagagacccagagctcaagtcacaggcggaacgactgtttaaccttgttcaccaggcttatgaagtgcttagtgacccccaaaccagggccatctatgatatatatgggaagagaggactggaaatggaaggatgggaggttgtggaaaggaggagaacccctgctgaaattcgagaggagtttgagcggctgcagagagagagagaagagaggagattgcagcagcgaaccaatcccaagggaacgatcagcgttggagtagatgccaccgacctttttgatcgctatgatgaggagtatgaagatgtgtccggcagtagctttccgcagattgaaattaataaaatgcacatatcccagtccattgaggcacccttgacagcgacagacacagccatcctctctggaagcctctcaacccagaatggaaatggaggaggttccattaactttgcgctcagacgagtaacttcggcaaagggatggggagaggtaagaatgtctattggctgagttgtgttgtctgtgcaaagccttatttctgaacatttacactctcaaagctcaccctcaaactcaccctgggggccccgttgttgtgtaagaacggtaccaagtgtcaagcttccataagttgactggtcctaaaagaaaaataggtctcatgagcctggccaacatggtgaaaccccgtctctactaaaaatacaaaacttagctgggcatggtggcacctgcctgtaatcccagctacttgggaggctgaggcaggagaatcacgagaatcacatgaacccaggaggcagaggttgcagcgagtcaagatcgcgccgttgcactccagtctgggggacaagagcaaa

SEQ ID NO: 370257 - DNA, 415 bp, Homo sapiens
tctacgtgtgtgtgacatttttggagagcttcctattttgaggctgtgggggatttaacactacagtcccagcccttgaggagcttagagagtgttgtggaagaactagaccatgggtgtcccaactttcttctgtcatgaatctgctccctgggggtcgaggaggctggagggagggaagggaaggtacctggcctcttctcaaatgacagctgcccctgaagtgatgaatgaggggcacaggcacagaccgcgttctctccctgcagagcaggcttctttgggacggtggtggagtacggagctgagaggaagatctccaggcacagcgttttgggtgcagctgtcagcgttggagttccacagggcgtttctctcaaagtcaagtaagttgaacttaggcctttcgggtcaa

SEQ ID NO: 370258 - DNA, 476 bp, Homo sapiens
ccaagtagattatgacttttcctaaaacttaacatgacagagatttgccttccagggggtctaatttgaagaggaaagtaatttaaatgtataggtttatataatagcattgtatttttctctattttattcattctttcattctcttcgatgactcccagcacctgcgcgtccatcttcattcttagccaatgacctttccttttacttaacagagaaaataacaatcagaagagtcttcataagttcccaccccgtctgcccgctttctacagccaaccccacatgccctgccttctctcctttcactgtggatgaaccgcccgtgccccaagcaaagacaaaccctccacttgaacactcacttgctgaaggatgtggcttaggcagttttcctgtctcctgaagccacagtattccccttcaactggattcttctcctcagcatataaatatacttttttttcctatcttta

SEQ ID NO: 370259 - DNA, 1248 bp, Homo sapiens
gctgtcaccatcgagcatggtttcctccctggtcctttccagaccccttactcccccctctctgaacttgcagttggaataggatagaggacaaggacatcagcaaaaacatgagcaactccccaggctccctttacctcactttctccacctgtgaacctgtggtagcccctctctgagtttgctgcaagggcccagtgagcttgccataatcagacgcagcagacacgggaagctcctgctctgccaccatgcagggatggaaaatctgtccactggaatccaggggaagggatggaagaggaagaaaaacaagcttggagcagtccaacccagctagggccctccattccctcagggacaccccacacccaccccacacactgggatgaacccttgcagaggaacaattcagatggtcacacattccaggacccaaatccgtaaacacaaagcatgtccgtcagtgccagcacctccccccggcgaatcaagcagctgtcccagagggcaaagggtctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaag

SEQ ID NO: 370260 - DNA, 2971 bp, Homo sapiens
attccccacttgctgtcgagttcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaaaacaaccatgacaacccaaaccccagccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgg

SEQ ID NO: 370261 - DNA, 3047 bp, Homo sapiens
gccccacagtgagaggaaggaaggcaacagtcgccagcagccgatgtgaagaccggactccgtgcgcccctcgccgcctctgcctggccacatcgatgttgtgtccgccgcctgctcgcccggaccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaaaacaaccatgacaacccaaaccccagccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgg

SEQ ID NO: 370262 - DNA, 2377 bp, Homo sapiens
gttgaggcagggccggggcgggagggcgctgtcacttggtgatggtgttcgcgttcatgctcttgccgctgccgctgagcacgatgtagggggtcttctgagccttctgcttctcctggagcagggccacggtgcccaggggcgtgtcgctggagctcatcttcttcaggagcgcctcctcgtccagcttcttcatccgccgctctgtcttcatcttgcctgagcccttgccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaagttcgtggcccctttccacatccttgcccccagcctgcccttcctgctccaggagccgtgccccggctgtcccagcccccatccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgg

SEQ ID NO: 370263 - DNA, 481 bp, Homo sapiens
  misc_feature (3)..(3): n is a, c, g, or t
tantactactaaattcgcggccgcgtcggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaag

SEQ ID NO: 370264 - DNA, 276 bp, Homo sapiens
  misc_feature (3)..(3): n is a, c, g, or t
tantactactaaattcgcggccgcgtcgacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgg

SEQ ID NO: 370265 - DNA, 369 bp, Homo sapiens
ccccagtgtgaaggagtgctgagaaaggggcacccctcctgatgagggagggagctgctgcagaactccagggggtgtgatcaggggggactccccatgcaggtcggtgtcagacctggctggggcccagctatgacctctctggtctggtcctcccagggggttgaggtgactggccagtatgagagggagaaggctgggttctcatggatcgaagtgaccttcaagaaccccctggtatgggttcacgcatcccctgaacacgtgttggcttccccctgcaactgcagggccgcttctggggcctggaccaccatggggaggaagagtcccactcattacaaataaagaaaggtggtgtgagcctgg

SEQ ID NO: 370266 - DNA, 4873 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370267 - DNA, 4663 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaaaacaaccatgacaacccaaaccccagccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370268 - DNA, 4556 bp, Homo sapiens
cgcagtactactacgttcttaggtagcgaggctgggtggcggctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370269 - DNA, 5103 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatctctgcacagccaggctggacctatccctgacagcatgctcttctgtttgaaaatctcctgtgacaaaggccattctaggtggagttgcctgcttcagcaccaccagccacctcaaatcctgatccagctgtgtctcgtgtcatgaatatgaaaatcgaaggtgcccccaaggccagaggccctgtcctaacagggggatcctgggaggggagtgacctgtcacatgtctcgatgttgaagtagtgagggaacccagccacacctagtcactgctccctccctcaacctcccactcctcaggaaggggctgcctaaacccagactttttcttcttttagaaacaaccatgacaacccaaaccccaggttcgtggcccctttccacatccttgcccccagcctgcccttcctgctccaggagccgtgccccggctgtcccagcccccatccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370270 - DNA, 4917 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatctctgcacagccaggctggacctatccctgacagcatgctcttctgtttgaaaatctcctgtgacaaaggccattctaggtggagtgtatgtgtggcaggatggggggctggagcttggtggcagcgctgctggttgcccgcctcctgactgccttcctgctccctttctgtttccggatgttcctgccctagtgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370271 - DNA, 4715 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggtactgagcccattaccggggcccaggccttcctcagaaaccagctgtgcttgggaacaggcagcgcccctcccctgcgtgtgtctcccaggcttcctctgtctctgacccttactgatccaccctttgtatctcaggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgg

SEQ ID NO: 370272 - DNA, 3574 bp, Homo sapiens
  misc_feature (28)..(28): n is a, c, g, or t
  misc_feature (3392)..(3392): n is a, c, g, or t
  misc_feature (3521)..(3521): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggtgtnccactcaggttccactttcttctattatctccagggagcataaatacctgctggctcccggatgaattcagaccctgggtctcagctcaggcacctgactccaggacccctgatgtcctgacatgctgntacacccttccgcgttggcatttgctgcttacacagcacctccgtcgtgggtt

SEQ ID NO: 370273 - DNA, 3630 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcggtgggtgtggggttgagatctcagcctcccaggtagcagagtttggacccagcgttctccccgatcttccctgcatcctgaccaagaccccaaccgtgcccccaacagactccccctgggagattcagcctattcactgatgaggaaagtgaagccgggtctcctgtctccccaaattcattgcacctacgatatagtccaggattgggtagcaagattaaacacaagcgcttcaaattgatgaaaaccaccctga

SEQ ID NO: 370274 - DNA, 1789 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgtatgacacattcccatgctgggggtgacgggagggccccgccagccgctggtgtgcagaggtcatcccacagcatcgttccttaccctctctctgcccttcctttctacctctgctcctcttgctgtctctgcccgctctcgcctgcccccagactactgtgacttaaaaagagggaagaggagccagcgcccgagggggccactggcggctggaggtccccattcagttgcactacaaacactgaccaaatatgcaaggaaggagctgtgtttgtttgttgtcgtcccagacagtgttgtgagggacctgaggccctgccccgtgtccgaccaccgagtggcaaggtggaaggaagcacaggcacacagaccgtgggtgggtctcctcaccgtggctgtgggcagtgcgaacacgtaacaccctcgggctaaaagtgactcgttgaccaagttggaaccggaatgctttcttactcaaaatggcttttgtaactattgatttctgaagctggttttatgagttgtgacagtgttaccaggttgggggtatgtgtttatttcctacaaagtacttacgggactaatgggcaaaacagagatttttaagtcttccgtatgctgtttgacttttatatttttaagttatattttcatactattgtatttaaaaactctttttagtccccaaagaaatgggtttatttgcctttcatggggtgtgggctggcaggaggaaaaatcgggagttttttatttggaatattattagatgatgccctatgataagatgag

SEQ ID NO: 370275 - DNA, 3066 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctggggggggcccccctctttttggggggggggggggggggggggg

SEQ ID NO: 370276 - DNA, 1793 bp, Homo sapiens
acccagtgtatggacatcaggcctcccctccccaaggcaggacttcacctgtcctttactttcactgagtaggatccactatactctagaggctgactcatgaggaaaccttctaggaagggagggcttcctccgttcagaaagccaacagaggtcccttgaactgttttctgatccccaaatctgcactccgaatgcagctgcacagccaggctggacctatccctgacagcatgctcttctgtttgaaaatctcctgtgacaaaggccattctaggtggagtgtatgtgtggcaggatggggggctggagcttggtggcagcgctgctggttgcccgcctcctgactgccttcctgctccctttctgtttccggatgttcctgccctagtgcctgcttcagcaccaccagccacctcaaatcctgatccagctgtgtctcgtgtcatgaatatgaaaatcgaaggtgcccccaaggccagaggccctgtcctaacagggggatcctgggaggggagtgacctgtcacatgtctcgatgttgaagtagtgagggaacccagccacacctagtcactgctccctccctcaacctcccactcctcaggaaggggctgcctaaacccagactttttcttcttttagaaacaaccatgacaacccaaaccccaggttcgtggcccctttccacatccttgcccccagcctgcccttcctgctccaggagccgtgccccggctgtcccagcccccatccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370277 - DNA, 1825 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaaggtagccagtgtccatgggtgtggcgtgagctgggggatgagagaacgcctgggaagtggggaagagcctccgcatgtgccagcgtgtcagcacaagtgcgtgtgcatccctgtgtgtgcaaaaaaatggtgcagacctcccgccaggcactaccccaagggccttactggtattctcccacctaatagaggggat

SEQ ID NO: 370278 - DNA, 890 bp, Homo sapiens
catgtacctgcagtaccagctacttgggaggtagaggtgggagaatcacttgagccgaggaggcacaggttgcaacgagctgagatcacaccactgcactgcagcctgggggacagagtgagaccctgtccctgccccaccaaaaaagagaaagaaaaaatgaggaaactgaaatcagaagatttaagggccttcccacccaaggccactccgtgacttcctggacaagaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370279 - DNA, 1617 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatgaagagaaggccaagagtttgctgatgagaatgcgggactcagggaaataagccacacagccccggcggttgagaccagatccaggtgacgcatggtgtctgcactctgattaccaggccactctttcccatgtggaagccctgacatctgggtcacggtgcttcatgggtcttgctgcccatccctggccaaactctcccttttgaaagcctctcgccacagatgtgttccctccttttggcccctattgctgtgacttctactgaggaaataattaaacccaaacaaaacacccacatgcctgaggttgttcattgcagtaaaaagcaagacacacaaggtccaggtgcagtggctcacacctgtcattcccagcactttgggaggcttaagcggggaggatcgcttgagcccaggagcttaagaccagccttggaaacaaagcaagatcccgtctctacaaaaaaaaaagaaaaagaaaaataaaaaaaacttttggagcgcgcctggcgggcccctaaagaaaaaggcttttctaaacacctgtggtgcggggcggagccgcggcacgcaatgatgattgagtacaacgttgcgactggcccggtttgccgaaggggaccccgggcactatactggatgcgtgggttgtctgcccacaattaaaaaaggcgcgcggggaactgcagggttttggaacctgatccaacggggatctgcgcggcctgacgggcacctcaccggacgggggctcagcgggatataatttaatacggggggggcgggaggaactttcaaaacaattctaggctgccccttaaggatgccgcacccaaagaggaaggggaattctggccacgaactcgtttgggagattgcttgaacccagaaccttcattactaaatacttttagaaaacacgacttcaggactggtggtgaacgacaatgtgccccaagtgccttttaatgaataccaacttgggtttacacgaagggcgcaataatggtgcaaaacacacggtgtggacgacttgctggacacgaaaacattgggagaggccggatcaacatg

SEQ ID NO: 370280 - DNA, 312 bp, Homo sapiens
gacatccctgggggggagcttgagggaggtccattattgttcatctcccagctgttgggggagaggctccccaagttggccgggtgtggggagaggggacatagctgccctctccgcacccactcctgggtggatctcaagccctggctgtgaagacccacaccccacctgagagaagactgcatctgtcgatttctccaaagctggagctgctggctcccggatgaatttcagacctggggttctcagctccaggcaacttggactcccaggacctcctgatgttcctgaccatgctgcttaccacccctt

SEQ ID NO: 370281 - DNA, 4609 bp, Homo sapiens
gctgtcaccatcgagcatggtttcctccctggtcctttccagaccccttactcccccctctctgaacttgcagttggaataggatagaggacaaggacatcagcaaaaacatgagcaactccccaggctccctttacctcactttctccacctgtgaacctgtggtagcccctctctgagtttgctgcaagggcccagtgagcttgccataatcagacgcagcagacacgggaagctcctgctctgccaccatgcagggatggaaaatctgtccactggaatccaggggaagggatggaagaggaagaaaaacaagcttggagcagtccaacccagctagggccctccattccctcagggacaccccacacccaccccacacactgggatgaacccttgcagaggaacaattcagatggtcacacattccaggacccaaatccgtaaacacaaagcatgtccgtcagtgccagcacctccccccggcgaatcaagcagctgtcccagagggcaaagggtctctgcagccatctgctttcatcagggctgcagcccccaggcagcagtactgggagcccctctcatctccgagaataaactctgaagccagcgaccctgcggacctgaatcatcagggagcctgtcagaggaggggcagtgactctgcgggacaagcaagcaggctatataagtttcagaaggctgggctccactcagatcttttccagcagctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370282 - DNA, 5210 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatctctgcacagccaggctggacctatccctgacagcatgctcttctgtttgaaaatctcctgtgacaaaggccattctaggtggagtgtatgtgtggcaggatggggggctggagcttggtggcagcgctgctggttgcccgcctcctgactgccttcctgctccctttctgtttccggatgttcctgccctagtgcctgcttcagcaccaccagccacctcaaatcctgatccagctgtgtctcgtgtcatgaatatgaaaatcgaaggtgcccccaaggccagaggccctgtcctaacagggggatcctgggaggggagtgacctgtcacatgtctcgatgttgaagtagtgagggaacccagccacacctagtcactgctccctccctcaacctcccactcctcaggaaggggctgcctaaacccagactttttcttcttttagaaacaaccatgacaacccaaaccccaggttcgtggcccctttccacatccttgcccccagcctgcccttcctgctccaggagccgtgccccggctgtcccagcccccatccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370283 - DNA, 4955 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaagttcgtggcccctttccacatccttgcccccagcctgcccttcctgctccaggagccgtgccccggctgtcccagcccccatccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370284 - DNA, 4636 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370285 - DNA, 4524 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaagggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370286 - DNA, 4660 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctggaaaaaaaaaaaatatttcattatatataattaaaatatataaattaaatttaatataaaactcggttttttttttttttttt

SEQ ID NO: 370287 - DNA, 3884 bp, Homo sapiens
ggaagaagggggctcagggaggaaccccctgaagaacccctcttctatgtggctttggtggtattccacggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370288 - DNA, 3856 bp, Homo sapiens
cgtagtagagactagcgcttttacgtacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccaggtgacaaagtaggaggtggggggaggggagattgacagattgggctcagtcctggctgtggagggtagtgccttgcccagctcctctggctggtgacagccctcgggcctcagttcagttgtatctgatcaggacttgaccacacagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370289 - DNA, 1512 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaag

SEQ ID NO: 370290 - DNA, 4105 bp, Homo sapiens
  misc_feature (28)..(28): n is a, c, g, or t
  misc_feature (4038)..(4039): n is a, c, g, or t
  misc_feature (4068)..(4068): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaaaaacaaccatgacaacccaaaccccagccacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgtctgattggcgtgggagggctcgtcttgactcgtcactggctcatcgagttgtcnntacgacgtgtgacctcaacgtacagcgangttgtgtgtaggtcctcttcactctgcggctcggtct

SEQ ID NO: 370291 - DNA, 3071 bp, Homo sapiens
  misc_feature (28)..(28): n is a, c, g, or t
aagcaggctggtacgccctggagttaanggatggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccctgctgcctgccagagaggcgccttcagagacccagcgcttacacaatacccaccatgtcccaggctggtgctcaggaagcccctatcaagaagaagcgcccccctgtgaaggaggaggacctgaagggggcccgaggaaacctgaccaagaaccaggaaatcaagtccaagacctaccaggtcatgcgagagtgtgagcaagctggctcggccgccccgtcggtgttcagccgcacccgcacaggtaccgagactgtctttgagaagcccaaagccggacccaccaagagtgtcttcggctgagaagtgtgcgccactccccttgctgcccgaatgctcggaaacaggagccttacccaggaactcttttttatgccagaacgcttcctctcccctgctgtctctggggctgccaccctcccccacagtccaggcccttcagccaagggctctgcaccagcaccttggaagcaccaataaagaggatgcccacgtggccccagcaaaaaaaaaaagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctctcggtttggggggggctttttggggcgggggggggggttttcgggggggggggggggggccccct

SEQ ID NO: 370292 - DNA, 1210 bp, Homo sapiens
catgtacctgcagtaccagctacttgggaggtagaggtgggagaatcacttgagccgaggaggcacaggttgcaacgagctgagatcacaccactgcactgcagcctgggggacagagtgagaccctgtccctgccccaccaaaaaagagaaagaaaaaatgaggaaactgaaatcagaagatttaagggccttcccacccaaggccactccgtgacttcctggacaagaggggaagcccagcccactccccaccctgactactgaggttctgtgcacacgtctctaccttcctgctcaagacactgggtctttccacagcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggtactgagcccattaccggggcccaggccttcctcagaaaccagctgtgcttgggaacaggcagcgcccctcccctgcgtgtgtctcccaggcttcctctgtctctgacccttactgatccaccctttgtatctcaggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 370293 - DNA, 332 bp, Homo sapiens
cctgggcttgctgtgggatctgggcagggagagggggtcactgaggcccctcggctctgaggttccagaaatattcttcaagcaaatcactattttctcaccctcatcccaaacccctgggtccaggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggtgccagtgtgccccaggtgggct

SEQ ID NO: 370294 - DNA, 945 bp, Homo sapiens
  misc_feature (752)..(752): n is a, c, g, or t
  misc_feature (757)..(757): n is a, c, g, or t
  misc_feature (761)..(761): n is a, c, g, or t
  misc_feature (763)..(763): n is a, c, g, or t
  misc_feature (767)..(767): n is a, c, g, or t
  misc_feature (776)..(777): n is a, c, g, or t
  misc_feature (781)..(781): n is a, c, g, or t
  misc_feature (785)..(785): n is a, c, g, or t
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggcggtggtgntcttnagancngtgncccggaggnnggcncttnactggttcttcccggcccggggtcactgtcatccccgtggtgtccccggcctccggtcgttggacggcggcgggagctctctcaaggggcgcggcgaaggtctatccggggggggccattgggaagcaagcgaattaagaggggggcttcagctctgttg

SEQ ID NO: 370295 - DNA, 739 bp, Homo sapiens
aaggcctgggtggtaatcggccgaggggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcaggggcttgtccagtcagtgccaacgcgcttgctgtccggctggggcccccccgtgggtcccctgtg

SEQ ID NO: 370296 - DNA, 383 bp, Homo sapiens
cagcacctgaagtttaagaggctgccccttcctgggtacctggccctgccggagagctctgggaccatctagtgggacccagtgcttgtccccaggccatcgtctgtcttaggtgctccaggcttccctgaaggaagagagaacagagaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370297 - DNA, 2396 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370298 - DNA, 2881 bp, Homo sapiens
aaggcctgggtggtaatcggccgaggggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370299 - DNA, 2823 bp, Homo sapiens
ttcatcccccttcatccccccttcctcgcccctccacagacccagggcatttggtggacacttttgcttgcagttaggtcaagtggaggtatggaagaacatggaaatccatggaggaggaccctatctgtcttcttccccctgccgcatcccagggctgtggcttgtcatgtggcacttgcttgggctggatccagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370300 - DNA, 2872 bp, Homo sapiens
ggctcacccggggcccactgccttccctatgcaggagacatacggaggtcatactcgtggtccagcccgacctagtgggaatccattaatctgcgactgaggaagagctcacgtgcggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370301 - DNA, 3144 bp, Homo sapiens
gagtgagcggagccggcgccccggccctgccgggagccccaggtgacttctcagggaggcgccccaccctgcccgctcagagggccagtgccgggtgggggtgcccttctagggccttcggtcgcaggtgggctctcccagctgtgacgacgcggccccggcctgaggagccccgcggacaaggttgagcgagtcgtgggctttttttccgtccccacgtgggcacggcccgggctgcgtgagctcacttcctccacatcttatctcctgccgggcgcgggcgcttcccatcagacagcaggagccagttctcagggtccttggctgaacacacaagctgcaaagctacatatactccggcagagctggctgcgggctgcagactgcagggccggtcactccgcgcaagtttgggttcctgttttagaactgccacctaagcccctcttatttcatctttcctgtggtggaaacccctgcccccaccggagtgtgaggttgactttttggaaagagagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370302 - DNA, 2284 bp, Homo sapiens
ttcatcccccttcatccccccttcctcgcccctccacagacccagggcatttggtggacacttttgcttgcagttaggtcaagtggaggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370303 - DNA, 1797 bp, Homo sapiens
cggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgccatggggtggacacaccgggctctggacggggagtagcggcattccctgcctctgcaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370304 - DNA, 2627 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggctaggcagccctgctgctgtgtggctggaccgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370305 - DNA, 1955 bp, Homo sapiens
cagctctggtcaggcctggctctgctgagcagctgtcctgagaatggccgctccacctgccagccagctgaggcttccctccctccttgcactgctggctggaagtggctggaagagatggagggaattaacctccttgcctggcacctggcttctgctaggaaccatggtcaaaggtgagagtgaggagggaacagaaagggagtgttgagctcggggtggctcatgttggttacagcatgaggggtcagcactcgcaggtctgctgcccaccctgcccccaggggctgcctttttgggtgtcagtttgtgaccaacggccttggctcccacgggtgctgctctcccagcaccatgcatggagaccactgggccccactgttccctgtcctccctgggcccagttcacagcaggtgtcaaggctgtgtgtgagatctggctagagcaggcccacctggccctgagatgccatccccacctcccttttggagctgggttgggtggtggtggggacaagcaacagagggagtgggactccaaacacatgtgggggtgacactgtgcacttggtggcctgggccccactgacccccagcctatcaccacaggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370306 - DNA, 2451 bp, Homo sapiens
aaggcctgggtggtaatcggccgaggggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370307 - DNA, 2685 bp, Homo sapiens
aaggcctgggtggtaatcggccgaggggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaagcacaagaaaacccgaaggacactcataagtcaggagtgccgagacaccagagcgtacacgcacatgggcccagggctaatcagcagtgtcctacccaagcttacatgtgatcacagtgggaaatccagccgggaccccaaatagagaagcccaacacaagccgaaagccaggtaaccggatag

SEQ ID NO: 370308 - DNA, 277 bp, Homo sapiens
cgcttcccatcagacagcaggagccagttctcagggtccttggctgaacacacaagctgcaaagctacatatactccggcagagctggctgcgggctgcagactgcaggtgacagtgccatatccctcactgcctgctccgccttgctaaggcttgaaccagaatccactaggagcaggactgtaagtgtatacacgcatacccctacacacacacacccctgcacctacacacaccctcatgcacacaccccctacctacacacaccccctcacct

SEQ ID NO: 370309 - DNA, 2497 bp, Homo sapiens
aaggcctgggtggtaatcggccgaggggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370310 - DNA, 2572 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370311 - DNA, 722 bp, Homo sapiens
agccaagtggggcctgaaagccctggcagcagtggctggtcccctccctgtcatggcttactggaccgggcagccctagggccttgccccctactgcctccccaggccagctgaggaagaggatgagcagtgcaggctggctcagccctgggtagcagggacagagcaggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggggtaagtgtgcacaggccc

SEQ ID NO: 370312 - DNA, 2763 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccaggtgggtcactgcacaggcggggctaggcagccctgctgctgtgtggctggaccgggagggaggggaatgctggggaaggaactgaggctggcatgtggggcctccctgagaatccatgtgcagaccacactcgggctccgtgctgggtgctcactgtgttggtggcccccacgtctgctcctactccacagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370313 - DNA, 3367 bp, Homo sapiens
ggggtggccaggaggaatttcctttcccattttccagatgtacaaaccaagacttagagactacctgtgacttgccaatgcctttccctgctctcagggcagaggtagaggaaggcagccaggattgcagtgaccaggttgtcatcagccacaaagccctctgagttctcatgttgcaggtgactggcccttaggccatgtagtgacattaaagtcctattggtcacaaccctaaactcctctccacagaatgtctttgagacttagaagggagggaaggtgtcagtgcttcctccattctgatacccttcttgcaagctcctcatccagggcctgaggctcccacctcgtgtcacctcaagacagccagagaggatgaaatctttggcttgggcttccagggctgtcataggcagagggcaagccaggatttgaaatagggaggccagaaacactgctggccaaggaagtggcttggccttgggaagcaagaaggcagcaacctctaggcgccccttctctccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 370314 - DNA, 1224 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccacgtgggcttcctcgttattttgccggctggccaacggcaggcgggggtctaaaggagtcgttctggcgccccatagggggtcccttggtgggggccgggggtaccctggtcccagggtcttggccacggttatccgaaagagagcacgtggggccggggcgactcctttggggaggtcccagggtggagggcgcagagcgcttggtgtg

SEQ ID NO: 370315 - DNA, 820 bp, Homo sapiens
ccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtaggaatgaggtggaactgccttgggttctcgtccagcaaactttgtctgtcacttttccagttgttccaaagttgaaatgtttgaacaagtcaaatatgctttcttggaactcatgtctccagtaggttttggccagatacaggagttataactttggtgtcaagtcaagcttgtcttctgttgccagaccttaccctggtctccccaagggttctgagtagaaatttcttgctgttgaagtctcagagtgtatgtcttgaattggtgctgacatcctggctgttctgctattcttgcccttgttagtcagaagagggctgaaactattgagcttttgtgatgtggattagttctcaccaggaaccagacagaaataatcaaattcctttgtcattattgctcaaaatgcttccttccatcatagtcacacgataggggcagcctgcattgt

SEQ ID NO: 370316 - DNA, 318 bp, Homo sapiens
tccctcatttaaagctctttttcccctaccttactttactcgatcatatctgaagtagggattgtgtgttccaccctccttgagggttgtgtggatttctcagcccacttcctgcccatggaagttttaagtttcaaatagtcacaatctttttaaagacccagcccatggccaggggcggtgctcatgcctgtagttccagcgacttgaggctgaggcgggagaatctcttgagtccaggaggttgaggtcacagtgagctatgattgcgccactgcactccagcctgggtgacagagcaagaccctttctctaaaa

SEQ ID NO: 370317 - DNA, 221 bp, Homo sapiens
ataggtgacgtatctttcctgcctcgtgaccccaggtggctcataatgctaagtttgatcacttgtttaaggtgatcttccagatctctccactgtggttattttgctgggtgtggtggctcacacttgtaatcccagcactttggaaggccgagatgggcaaatcacttgagtccagttttagaccagcctgaacaacaaggtgaaaccctgtctctact

SEQ ID NO: 370318 - DNA, 1094 bp, Homo sapiens
aaaattctatcaatggatttgccaaatagcaaaactgctttagagactgctgtataaaggaagtacaggtagtctcttcttacccacatgtgatgcatttctgaaaacatggaaaaactactgcatctgagagaaagctgagaaatgaacagaagtctgatggtgccaggtcagagaggtctgtgtcatttctcagctcattggttaattcacacaggattgatcaggtacctcatgcatggggccttacccaatgtattgtaaaaatgaaatgtcaaagggaggctgccgcgggtactcaatgcaagtccaggttagggaagaactaaaggaagcacttcatagccagcatttcatatcgctgtccgtctgatggttgtttttaggtgataggggtgtcctggtggatataatgtataaggcttggttggaaggcaatctcagattaaaattcccatcagtagtagccatattgaattttctggggattcaaaggtgaactagtaagagtactttccagaatctagtgagcatatttttctgtttgtcagttggacaaaatagcgccttttgttttgcttctctctgttaaggggaaagaagtaaagctgtaattgtcatataattgctgagcctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgaga

SEQ ID NO: 370319 - DNA, 2624 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgaga

SEQ ID NO: 370320 - DNA, 3281 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaaaaaaaaaaaactcgagtttttttttttttttttttttttttttgagacagagtcttgctctgtcggccaggctggaatgcagaggcacaatctcggctcactgcaacctccacctcaagggagattttcaaagcaacattgcctctatcataggtagtcttcaatgtaatactggcaccaacaagagaaccgagctaaattaaaactaccctcaaaatgtcatcacagctgatgtgca

SEQ ID NO: 370321 - DNA, 3456 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaacaaaaaaaaacaaaaaaaacaaaaaaaaaaaaaaacaaaacaaaaaaaacaaacaaaaaaaaacaaaaaaaaaaaaaacatcaaagaccaaaacaccacaaatacaaacaaataacaaaacacaacaacaaacgcacgaaaaacaaaatcacacacacaggggctagcggagaacaaggcagaagaggagcgggcggatgcgcgcagaccaagcaggtcgggaaagaagcagaagggagaggaggcgcgcaggaaggaggagaaggtgctcgggcagggcggggaggagagagaggagagggggacaaccaaggagagaaggaagaaaggggaaggaggggggagaggtgagcagaacacagtggcgggggcacgacggccagcgggtagatacagagacggggcaggaagagc

SEQ ID NO: 370322 - DNA, 2985 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370323 - DNA, 2984 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370324 - DNA, 1354 bp, Homo sapiens
agctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370325 - DNA, 1509 bp, Homo sapiens
aaaattctatcaatggatttgccaaatagcaaaactgctttagagactgctgtataaaggaagtacaggtagtctcttcttacccacatgtgatgcatttctgaaaacatggaaaaactactgcatctgagagaaagctgagaaatgaacagaagtctgatggtgccaggtcagagaggtctgtgtcatttctcagctcattggttaattcacacaggattgatcaggtacctcatgcatggggccttacccaatgtattgtaaaaatgaaatgtcaaagggaggctgccgcgggtactcaatgcaagtccaggttagggaagaactaaaggaagcacttcatagccagcatttcatatcgctgtccgtctgatggttgtttttaggtgataggggtgtcctggtggatataatgtataaggcttggttggaaggcaatctcagattaaaattcccatcagtagtagccatattgaattttctggggattcaaaggtgaactagtaagagtactttccagaatctagtgagcatatttttctgtttgtcagttggacaaaatagcgccttttgttttgcttctctctgttaaggggaaagaagtaaagctgtaattgtcatataattgctgagcctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370326 - DNA, 566 bp, Homo sapiens
ggccacgtgcttctatgtggtgtttgactctgtacaaagtactcttttattcttcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370327 - DNA, 1744 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaagttttgggtaaggatgtattttctctttagaaactgaaagtaaaaagatgttgagaatacagtttgtttaaaatattaggcgttatgtctattgaactgccaatgaataagtgtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttg

SEQ ID NO: 370328 - DNA, 1786 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgcgatatgctcccacccccgcaaggtcaacctgggagtgggagcatatcgcacggatgactgccatacctgggagtggggagcatatcccaaggcctgtcctccaaacaaaaaaaaacaaaaaaaacaaaaaaaaaaaaaaacaaaacaaaaaaaacaaacaaaaaaaaacaaaaaaaaaaaaaacatcaaagaccaaaacaccacaaatacaaacaaataacaaaacacaacaacaaacgcacgaaaaacaaaatcacacacacaggggctagcggagaacaaggcagaagaggagcgggcggatgcgcgcagaccaagcaggtcgggaaagaagcagaagggagaggaggcgcgcaggaaggaggagaaggtgctcgggcagggcggggaggagagagaggagagggggacaaccaaggagagaaggaagaaaggggaaggaggggggagaggtgagcagaacacagtggcgggggcacgacggccagcgggtagatacagagacggggcaggaagagc

SEQ ID NO: 370329 - DNA, 797 bp, Homo sapiens
cacccggttcagaaatcaccagatagtagtttctcgtgtccgtgtgtgtgcctctgcctgctcggaacctacatgtacatacctactggaattagagacagtttgctggacatgaaaggcgttgcatctgtgttgagcgcagtccttctgatataaatccgttccctcatgatagagtaacatcaccacttaaaaagcgcaatattggacggactgtggattgtgatgccgtataggtcgcgtcaagacggcaaattgagattgaaagttccgggaacgtaccatatagatattttgatcactgatgactctaggtatcttgtcgctctcacctaaaattgggacgtgtgtgttctgctgggtcgtgccaccgttgctgtctattggtgggctggtgttggtactgcctgttagcgggtcttactaaggtgtgcctccaatacggatcataggtctgttcgtgacatggcatgctcgcaccgtcggtgcatcttgtttgagtgttgtcgcgcgtcggcggcaatttaactttcatgcgattctcacaccccattagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370330 - DNA, 3039 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370331 - DNA, 3156 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagatgagggaagagtaagtagggaggggtagattattgtaaaaataaagagaaaattaaatttggggggggggagtaaagacaaatattcccccggggggggggccgggacccaattccg

SEQ ID NO: 370332 - DNA, 3128 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370333 - DNA, 2888 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370334 - DNA, 2834 bp, Homo sapiens
ggcagccagaatctaaacctagatagtccggtcccggagataggtttttaaccacaaaggcattttctaaaattgtgaaagtacagaagcacaggaaagagacattttggccagataagggttaagggaaggcttcatggatgaagtggcattcgctctgggtcttgaaggtcagcagatggagagggctcctggggaggaaggactctaacggggaaggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370335 - DNA, 1443 bp, Homo sapiens
agctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaaga

SEQ ID NO: 370336 - DNA, 227 bp, Homo sapiens
tcttgattcctagtctctcgatatggcacctccgtcagtctttgccgaggttccgcaggcccagcctgtcctggtcttcaagctcactgccgacttcagggaggatccggacccccgcaaggtcaacctgggagtgggaggtaaggatgtagtgctctggagtgtgagcagctcggggagtggagcggacccaacccaggtcgtggagactgtgggagaagccgagg

SEQ ID NO: 370337 - DNA, 294 bp, Homo sapiens
aatggttctaacgtgtaagtattagcagtcatactgtagcataagaaaataccgtctgctgaaagaggaacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaagaaaaagaaaagaaatatttaagtcacatatgtgatttc

SEQ ID NO: 370338 - DNA, 2086 bp, Homo sapiens
atatctgtagttttgcgtctggcttctctatttaattcttaaaggggggtgggaactaaacagatcacaagggagctgcccacagaggtaaagacaaggtcagataggctgagagacgcaggaaagcgggtcaatgtgtagggctggagggcaggggcgggccctgggcctgggctgggggtcctgccccggggcgcacccagggcgagggctgcccggaggagccgaggctggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370339 - DNA, 1702 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370340 - DNA, 2327 bp, Homo sapiens
atatctgtagttttgcgtctggcttctctatttaattcttaaaggggggtgggaactaaacagatcacaagggagctgcccacagaggtaaagacaaggtcagataggctgagagacgcaggaaagcgggtcaatgtgtagggctggagggcaggggcgggccctgggcctgggctgggggtcctgccccggggcgcacccagggcgagggctgcccggaggagccgaggctggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctcctgtatggccagaaggcagggccgaggggtgtgggcgggaggcccggcctggcttagtggggacccagggcatcagacacaggtacagcacatgggccaggagccagggggtgactggggtggctcggctcgggaggcttgggaccccaagtgcacgctgtgcccctgatgatgtgggagaggaacatgggctcaggacagcgggtgtcagcttgcctgacccccatgtcacctctgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370341 - DNA, 1969 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctcctgtatggccagaaggcagggccgaggggtgtgggcgggaggcccggcctggcttagtggggacccagggcatcagacacaggtacagcacatgggccaggagccagggggtgactggggtggctcggctcgggaggcttgggaccccaagtgcacgctgtgcccctgatgatgtgggagaggaacatgggctcaggacagcgggtgtcagcttgcctgacccccatgtcacctctgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370342 - DNA, 2487 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccaccgggtgctttctgcccaacccctgctcttgccagctggcccctgcttcccctagggcacatgctggaagccctgggctgccaccagaggtcctcagccctcctgcctgggctatggctccttcctggtttgggagccatagtggagctttcctctctaagctcacccagctcaaactgtgacaggagaatcttcttcgactgccaagagcggtccaaggcaatggtcagccactgcagcctcctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctgtccccgaggtggctgggaggtggctcctcaaacagccgctttctcatcagtgcccagtgctgggtcagggatcgactgaggctctgagctaactgggaaacacagtggccttggagggctggggagtgtcatgggggtggggacagggagccaccggtcgcatgtgactgaactcttcaccccagtctgtgactttcccgttgcagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370343 - DNA, 1728 bp, Homo sapiens
atatctgtagttttgcgtctggcttctctatttaattcttaaaggggggtgggaactaaacagatcacaagggagctgcccacagaggtaaagacaaggtcagataggctgagagacgcaggaaagcgggtcaatgtgtagggctggagggcaggggcgggccctgggcctgggctgggggtcctgccccggggcgcacccagggcgagggctgcccggaggagccgaggctggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctcacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370344 - DNA, 1497 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagcactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370345 - DNA, 1243 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggttcataaaatagtggctttcaaactgta

SEQ ID NO: 370346 - DNA, 1604 bp, Homo sapiens
atatctgtagttttgcgtctggcttctctatttaattcttaaaggggggtgggaactaaacagatcacaagggagctgcccacagaggtaaagacaaggtcagataggctgagagacgcaggaaagcgggtcaatgtgtagggctggagggcaggggcgggccctgggcctgggctgggggtcctgccccggggcgcacccagggcgagggctgcccggaggagccgaggctggcggacagcttggccctgagcttgaggggaaggcagcgatgggacaaaggacggaggtctaggaagagggtctgcagagcagaaagcacgggtaggggcggcctgacgctcggaagacaacggatgggagccgtgtgcacgtcgggagctcggagtgagcgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370347 - DNA, 1660 bp, Homo sapiens
aatggttctaacgtgtaagtattagcagtcatactgtagcataagaaaataccgtctgctgaaagaggaacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaagaaaaagaaaagaaatatgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcagcctcctcttctgtcaccaactgggaacccacctcttcctgaaagtcctcccccactgactcaccggcttgccccaagcttgtcaagaatgtcccagtaaccaggtggcacacactgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattgtaaatattaaattaatcaaaacatgcaaaggaatggaacagtgcctggcacctaggaagccttcaggaaatgctatctcttccctgttgataatcttgacccgtacactgcctttggttgccattcatgaacctgccaccaatagtaacaaagtgctggatgcaccttttgtgcttatctttgtgctaaatgtgcccgagggacgcctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgcgttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcagaaattaaccaatcagtagagcagccttcggagtaagggctaaaatgatgtcctcagggcctggttttgctttccttccatgtcagtttgcttctttgggtctggctgcattcccagacaggccatgctgtcgtggtag

SEQ ID NO: 370348 - DNA, 1588 bp, Homo sapiens
gaggcgagctggagggctgcagcttcttgtattggcagtgctgacctcgcacagtccttgggctccagtgacttcactcagtgtttatctaacatgagtgagtgaatggtgtttgctgtttttttggcaaaggtcccaggggttgtcgggtacacaggtcctgtctttggccataagcaaactgaaatgaggcttggtctccttcccaggattccacaccatgcctcacatggtagaccccagcgggaagtatgtgactgcctgactcaggtgcctctcgtggtccaagccatccctgccctgtcccttccctggttgttgccagacctggagcccctgctccttcgctttgcagcctcctcttctgtcaccaactgggaacccacctcttcctgaaagtcctcccccactgactcaccggcttgccccaagcttgtcaagaatgtcccagtaaccaggtggcacacactgaagtgactgaggggttaccttggagttgatgccttggctcagatccagctcccctgttttcttcctctgtaaccttgggcaacccaacccctctaagcctcggtgttctcatttgtgaagttgtggtaataatggtagcttcctggtagaattattgtaaatattaaattaatcaaaacatgcaaaggaatggaacagtgcctggcacctaggaagccttcaggaaatgctatctcttccctgttgataatcttgacccgtacactgcctttggttgccattcatgaacctgccaccaatagtaacaaagtgctggatgcaccttttgtgcttatctttgtgctaaatgtgcccgagggacgcctagggaagaggatgcaggtctttaagagccatcagctccagattatggccaccccatgtccagcacttagaatggaggccaaaaccattccctcggaaattgtgtttccttgccaagatggggactgcgtggttgcccttctctgagggcagcgctggatttttggcgtctttcctttcctgtcctggtacttggcaccttgtagacagttgcatgtcccctgcccagggatgggatgaggagagggcaggaaggcatttcctgggtagtggagtgctgcgttcattgagtgtgggttctccaagctgctggcacagcgcagggagggccagatgcctctcaggagccttgggcctgagtcctggctccctcactcctgggttccaggtcactgcatctgtctctccaccatgtgctccacctcgtgctggaccttaagagataccaattatgtggctgccactgtgtcctagaggctggaatgggaacacatagggcgagattgattgttaattgctagcatgaaccgcgtgggcttctcagggtctagagtggagagaaatcggtaagaattggtggcacgcctgtcagaactccccagaccaagctaagcagaaattaaccaatcagtagagcagccttcggagtaagggctaaaatgatgtcctcagggcctggttttgctttccttccatgtcagtttgcttctttgggtctggctgcattcccagacaggccatgctgtcgtggtag

SEQ ID NO: 370349 - DNA, 1728 bp, Homo sapiens
gcggcggcgggagcttccgggagggcggctcgcaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370350 - DNA, 1880 bp, Homo sapiens
agcagagtcccatctatgcgctcctggcctctcagcaaatgctctgtcccctactcccctatctgtgcaggctgaagctatgtgcatagttgggatgagggctgtgttgtctcaacaccacgctgccctgtggtgggggcgtgccggtggtcgtgggtggctctgatgctccggctccgacccacaggcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370351 - DNA, 1966 bp, Homo sapiens
aatggttctaacgtgtaagtattagcagtcatactgtagcataagaaaataccgtctgctgaaagaggaacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaagaaaaagaaaagaaatatgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370352 - DNA, 2420 bp, Homo sapiens
gcacatggagtgtggccctgtgggcaagggctgggctcttggaggtaggggagctacaggggcgactgggaggaggatgtcgtgttacacacgcatcagagttaactttgcagtgagagcggccttgctgcggccaaagaacatggaaaagcatgagtggggtgatgtgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccctgcaccagggaggatggaagcaggtgaggagctagaccacactgaggcggtggtcgggactcagggtttgctcagtgagccgttcactatgtgcaggggcagttccccgtctgaatttaggtgacgacactcaggtccagccttgccagtctcagcctccggtctccgttccccctctgcagaggccactttgtctgctgcacgtgatcatgaggggctgtgaagtgcttgccccatcagtagccatgtgtgcatgtgtaaataccatcctctgtgtgccctggaggctgtccttcagatagcatgtacaggtggcagcatagggcctgtccctactgagagtgcagggaactcagcaccgtcaactcctcgaccctgcaggtcagattatccttgtagaggccccctggatggcaccaagatcggccctggcaagcaggtgaccctgacttcagagcccttgcctgagggctggcctggcagctctgctgttagaagcaggaggtgtgcagggggtggggagcagcccagcctctgtgatcttctccatggcaggatctccgatctcccagcgggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370353 - DNA, 1443 bp, Homo sapiens
cagaaagagaagaaaacaacggcaggggccggggtatcggacgagggagctccgggagggcggtcgcaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctcctgtatggccagaaggcagggccgaggggtgtgggcgggaggcccggcctggcttagtggggacccagggcatcagacacaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370354 - DNA, 807 bp, Homo sapiens
  misc_feature (15)..(15): n is a, c, g, or t
  misc_feature (51)..(51): n is a, c, g, or t
gaagtatggcttttnatgcatccttcatcgagggcattgaagttgcatggnctgataaaagttgatgcaaaacaagaaagaaacaaaccctcaaccgcggcccctgtaggccaaggcgccaggcaggacgacagcagcagcagcgcgtctccttcagtccagggagctcccagggaagtggtcgacccctccggtggccgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctctgccgccaccgcagcagccacaggcagaggaggacgaggacgactgggaatcctagggggctccatgacaccttcccccccagacccagacttgggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtacttcatggggggacggctccacccagcctgcgccactgtgttcttctcttaagaggcttccagagaaaacggcacaccaatcaataaagaactgagcag

SEQ ID NO: 370355 - DNA, 947 bp, Homo sapiens
aatggttctaacgtgtaagtattagcagtcatactgtagcataagaaaataccgtctgctgaaagaggaacaataaagattatctacatggtcatcatttaaaagctaccagatataggaagaaggggccataaaatgataacgttatgatgattaattttgatgcttaggtcagagtccattctaggatatctgctgcccaaaaacagcagagactcatttctttggaatcacaggacgctgagtgagaggaaagaaaaagaaaagaaatatgcaccatgactcctgtgaggatgcagcactccctggcaggtcagacctatgccgtgcccctcatccagccagacctgcggcgagaggaggccgtccagcagatggcggatgccctgcagtacctgcagaaggtctctggagacatcttcagcaggtgggtgctgccactcacccccacctgatgagagggccatccctgtcctgggcaatcccagcaacacaccctctgggagcagcccccttggggaatcccggtcctggggaacccatctggcttccctgtgtgggaggggctgaagtgagagcccaacttggaagcttttactcctgggagtccgagagctcactcccttccaccccacttagcctcctggtttcctgtggtggctctgctctcacaactcatgcttttcctcccattggagggcctattccttcacgttttcctgcagccaacaaatatttacccagtagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcaccac

SEQ ID NO: 370356 - DNA, 409 bp, Homo sapiens
actagagctaagagaatgtgaaagaaaatttctagccttgagtgttgctgccacctacatggtgggaagactacaaacaaaatctaacacctttcagacaggcatcagctgcagtatgttttctatgaaaatgtactttagaaatccccaaatttgtttatttacttcactatcctgaaggcatgttagtatttgttagtttcgcctcattttctatctcaaatacttgcagacattggagtaaatggttttgcttagactggtgtgaatacactgattatttgaaatagaagccgattcaaagaattcttccttattataaaaaaatcccaagtgcaacttgatccccatagctatgtcttagggaaaggatgaaggttcttaatctcactgtactagaggtcctccc

SEQ ID NO: 370357 - DNA, 4360 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370358 - DNA, 709 bp, Homo sapiens
ggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaa

SEQ ID NO: 370359 - DNA, 4362 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcattcgccaggttttaagtgtaggaccctacttagggcccccacccccgaccttcgttaataaaaggccctccatatgccca

SEQ ID NO: 370360 - DNA, 4189 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgagctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370361 - DNA, 2896 bp, Homo sapiens
  misc_feature (12)..(12): n is a, c, g, or t
  misc_feature (33)..(33): n is a, c, g, or t
  misc_feature (49)..(49): n is a, c, g, or t
gggctttgcagncctgtgctctaataaaaatancccgaaacagcttgtncacttgctccaatgtatttgctgagtaactctggccccttgacacttataaaattcattctactctctcgtgcaattaccccagctagtaaggttttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370362 - DNA, 3962 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctgtaagtaacagattctgttttggaagtacagctactattacaagtgacatagtattacacttaaacctttaaagttcgtgtttaaaataaaaatattttgaatatttaaaagctaattcaaaaaatatgtg

SEQ ID NO: 370363 - DNA, 3502 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtaataattataaatacagaaatagaatgttataacaaaatgtcatcatgtcatcagattttggtaaaaaaatgttcttttttcctctaggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaaaatgcaagaaacctaatgtattatattttcacattatcttctgttcaaagattacatacttccattatcctgtcaaa

SEQ ID NO: 370364 - DNA, 2621 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaagtatgttttactattaaaacctgaacttggaatcttctttctattgtggagaaatgtaattgtagtaagacaagaattaaatatattccattgtagtatttgaataagcagttatttgagtagaaaattagtgtttccagc

SEQ ID NO: 370365 - DNA, 1420 bp, Homo sapiens
gtttattcctggtctttagaagctgctaccttttgttatctaattttgcagtactttgaagtatgtatgtatgtgtacatacgttagtgctatgtatttattaaagaagaatcagaaaacagaggtaaggaaaaataaggaaacaaatttctgttaagcccaccacctcccaaagcatatttgtttatatgcttatatatgttttcctattatggtaagaacagtctgtacatattgctatatagcagtccccctttatccacatacatcctgaaaattgttttacattttaaatgttaactactttattgtttttaaatgtcattttatagtgtagctatgccacaatatccaatttttagacatttaaattgctcccaggcaatgtggtaatgaacattcttgcagctgaatatatgcacatatctaattgtttcactaggatagaggtggaattgtataacagggagctcacattttttaaggcttttgaaatgtattgccaaattgcctgccagatatactgcaccatcactaacattgtgtgttgcagtatttttctaaacttggcccttttgattttagaaaaatgatatcaataatttacatttctttgattaaagtgtagaagttataatttttcatattattcattgtcatttgtattttatcttttctaacttgtctcttcatcccctttgctccgttttctattggagtgcaactttatttgtaagaattctttttaatttctgtgactggaatttttttttctagtttgttatttcccgttcatttcttaaaatataattgtgtttgccaacaatccattatcttttgttttgtaatggtagtatttatacatattaaattatctctttcttttttcagatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370366 - DNA, 2027 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctgggttagtataaattttataacttgggagaaattttatgtggcttaaacatccccaaattatgaattagaatagtatttcatatataaattgaaaatcaattaaaaagaaacacagtgcctaaaggcacttgggggacacatttacgctttgcagtaaagtccttgtttggataaagattgtatgttttctggccaagtaagcttgaataggtacaagcttagataggttcaggccagagaggtcaaaattacttgcctgagattgcatagctagtgttacaactaggattcaaacccaggcagattgacttgggggttcatcaggatggagtgccctacaaagcctcccatctttaatgcttgcagatttgttccccagttaccgaaagcaacttgttaatattagggaaaagggccagtgtagggagagatccatggcatgaggtaaccttcctgctgcatgtggtggcacctggattggaatgcatccaggagctgcttaccctgccggtgtctgctctttaatttgtgtataacggagaggaagtagacagggcaactagtgctccagcccctcatcctggccacaaatattaatgctacctttatatgacataagtcactagtccatttattggaacctaaatttgaaccactgtaaagtaagacttcatagtgataaagagaggaacttgttaggaaagagaataaaatagaaagagaag

SEQ ID NO: 370367 - DNA, 240 bp, Homo sapiens
aagaaaacagtgaggaaattgactttattcttccttttttaaagctgagctctttggggtaagaagttatggccaaactagcatgttagacatgtttttaacactatatctggcagagttttcaatgtaaatattaaagtagatgttaatgtcaataagtgatcttaataatgcatcagtagatattttttcaaggattgtctctatcttcacgcctagcttataatttgccttgtcgtc

SEQ ID NO: 370368 - DNA, 385 bp, Homo sapiens
acagatagttttttctctccccctcttccttccatctttcattactacaatttaccatgcagagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctatatttataaacaagggaccagaacacattaac

SEQ ID NO: 370369 - DNA, 4238 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaattta

SEQ ID NO: 370370 - DNA, 4258 bp, Homo sapiens
  misc_feature (4114)..(4114): n is a, c, g, or t
  misc_feature (4123)..(4123): n is a, c, g, or t
  misc_feature (4183)..(4183): n is a, c, g, or t
  misc_feature (4199)..(4199): n is a, c, g, or t
  misc_feature (4215)..(4215): n is a, c, g, or t
  misc_feature (4225)..(4225): n is a, c, g, or t
  misc_feature (4247)..(4247): n is a, c, g, or t
  misc_feature (4250)..(4250): n is a, c, g, or t
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattggggaccanttttaacangaattcccttattttttaattttccctaaaaaattttaaaatttcaaggcctttttaatnggaaaaattaaattantttaagccccaaaatngggggggggnaaccctaaaaatttaaattttnccntttttggg

SEQ ID NO: 370371 - DNA, 4650 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagtatggctttttccccctcattataattgttaaaacttcttaaaaattgtttcacccttttgatatatatttctttgacttataaacgagctatatttataaacaagggaccagaacacattaactcagtcatggttatgtgcttccttgctttcaatgtttcattatcttataaggaagagaacgtatggtctcttgaaaaaactgacaataagaagtaacaactggactaccacatttttttttacatccttaatttaactcttcgtcaatttctttttttacttaaggaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370372 - DNA, 1520 bp, Homo sapiens
ggattacaggcgtgagccaccatgcccagccttaagagtgtttgattttcattcattttcctatatatattatttctgttggggaaaaaattccaaggaagataaatagtaggctgttggtacatttctcaacttacttataaagctttttagatatataaggttaatttatgaagaaaatcataagatacacaatttaagataatatttttaattttattttttatttgttaaataaatttttctcctttcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggatggaagttccagctctgatagtgacctaagtctgtcttcaatggtctttcttaaccatagcagtggctctgacgattcagctggagatggagaatgtggcttagatcagtcccttgtttctttagagatgtccgagatccttccagatgaatcaaaattcaatatgtaccggctctactttggaagctcttatgaatcagaacttggaaatggaacctcttctgatttgagctcacaatgtctctctgcaccaagctccatgactcaggatttgcctggagttcctgggaaagaccagttgttttcacagcctccagtgttaaggacagcttcacaagagggttgccaagaacttacacaagaacaaagagatcaactgagggcagatatcagtattatcaaaggcagataccggagccaaagtggagaggacgaatccatgaaccaaccaggaccaatcaaaaccagactggctattagtcagtcacatttaatgactgcacttggtcacacaagaccatccattagtgaagatgactggaagaattttgctgagctatatgaaagctttcaaaatccaaagaggagaaaaaatcaaagtggaacaatgtttcgacctggacagaaagtaactttagcataaaatatacttctttttgatttggttctgttaagttttttgatggcttttccatatgttgtaacaggaaaaaaatggtgtctatgaatttcttcttaatttaacaaatttggttaatttataaaatcacagattggtaaatgctataattatgtaatgatcaggattgagattaatactgtagtataaattgggacattataacagattccatattttatttcctaaaatctaaattcagtctttaatgaaataatattagccaaatggtggaactaatttatttcttttgaggaaaagataataaagaatgtaattaaatttaaatttcttggaattcccagttgtatattcatcacctttgtagcatttgacaaattttatgcttagcagcttcttcactgttttgaaataaaatatcctattacctactgataaaaaaaaaaa

SEQ ID NO: 370373 - DNA, 3412 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgacaatttcatatttagagtccaaaacccaacaaatgctacactctttccttgtgagctttacttctgccaggtaatggcaattgtccttagaagaccagctttcttagggaaaagctttagccactgtttgctcaaagcataaaaagattctgaattagatgcaaagcctttttttggcccagtgcaagtctgaaaactttgtaatccttctgtgttggctgattggggaaaaaaaaaaatgcaagaaacctaatgtattatattttcacattatcttctgttcaaagattacatacttccattatcctgtcaaa

SEQ ID NO: 370374 - DNA, 3549 bp, Homo sapiens
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacctgccaagtatccagaattatttgcaaacttgcccatacgacaaagaacaggaatactgttgtatggtccgcctggaacaggaaaaaccttactagctggggtaattgcacgagagagtagaatgaattttataagtgtcaaggggccagagttactcagcaaatacattggagcaagtgaacaagctgttcgggatatttttattagagcacaggctgcaaagccctgcattcttttctttgatgaatttgaatccattgctcctcggcggggtcatgataatacaggagttacagaccgagtagttaaccagttgctgactcagttggatggagtagaaggcttacagggtgtttatgtattggctgctactagtcgccctgacttgattgaccctgccctgcttaggcctggtcgactagataaatgtgtatactgtcctcctcctgatcaggtgtcacgtcttgaaattttaaatgtcctcagtgactctctacctctggcagatgatgttgaccttcagcatgtagcatcagtaactgactcctttactggagctgatctgaaagctttactttacaatgcccaattggaggccttacatggaatgctgctctcgagtggactccaggcaagttatatgaggaagttgttatgacattttatgagtgataaaagaagtacaatgtcaaaatttccaccttaaaaaatgctattttttaaacaactttggtaaaactgtatagaaacataaatttacctttagttgaatgttccatagttggaatatgggttttgcagagaatttataattatgaagtttgatgtctgtttctttaacattaccttaatattggcaaaaacatgttggtgtttgcaaggatattatttaaattgggataccatgaa

SEQ ID NO: 370375 - DNA, 2540 bp, Homo sapiens
  misc_feature (2486)..(2486): n is a, c, g, or t
  misc_feature (2499)..(2499): n is a, c, g, or t
  misc_feature (2535)..(2535): n is a, c, g, or t
cctgccgggtcccgggtcctttgcggcgctagggtgggcgaacccagagcgacgctccgggacgatgtggggcagcgatcgcctggcgggtgctgggggaggcggggcggcagtgactgtggccttcaccaacgctcgcgactgcttcctccacctgccgcggcgtctcgtggcccagctgcatctgctgcagaatcaagctatagaagtggtctggagtcaccagcctgcattcttgagctgggtggaaggcaggcattttagtgatcaaggtgaaaatgtggctgaaattaacagacaagttggtcaaaaacttggactctcaaatgggggacaggtatttctcaagccatgttcccatgtggtatcttgtcaacaagttgaggtggaacccctctcagcagatgattgggagatactggagctgcatgctgtttcccttgaacaacatcttctagatcaaattcgaatagtttttccaaaagccatttttcctgtttgggttgatcaacaaacgtacatatttatccaaattgttgcactaataccagctgcctcttatggaaggctggaaactgacaccaaactccttattcagccaaagacacgccgagccaaagagaatacattttcaaaagctgatgctgaatataaaaaacttcatagttatggaagagaccagaaaggaatgatgaaagaacttcaaaccaagcaacttcagtcaaatactgtgggaatcactgaatctaatgaaaacgagtcagagattccagttgactcatcatcagtagcaagtttatggactatgataggaagcattttttcctttcaatctgagaagaaacaagagacatcttggggtttaactgaaatcaatgcattcaaaaatatgcagtcaaaggttgttcctctagacaatattttcagagtatgcaaatctcaacctcctagtatatataacgcgtcagcaacctctgtttttcataaacactgtgccattcatgtatttccatgggaccaggaatattttgatgtagagcccagctttactgtgacatatggaaagctagttaagctactttctccaaagcaacagcaaagtaaaacaaaacaaaatgtgttatcacctgaaaaagagaagcagatgtcagagccactagatcaaaaaaaaattaggtcagatcataatgaagaagatgagaaggcctgtgtgctacaagtagtctggaatggacttgaagaattgaacaatgccatcaaatataccaaaaatgtagaagttctccatcttgggaaagtctggattccagatgacctgaggaagagactaaatatagaaatgcatgccgtagtcaggataactccagtggaagttacccctaaaattccaagatctctaaagttacaacctagagagaatttacctaaagacataagtgaagaagacataaaaactgtattttattcatggctacagcagtctactaccaccatgcttcctttggtaatatcagaggaagaatttattaagctggaaactaaagatggactgaaggaattttctctgagtatagttcattcttgggaaaaagaaaaagataaaaatatttttctgttgagtcccaatttgctgcagaagactacaatacaagtccttctagatcctatggtaaaagaagaaaacagtgaggaaattgactttattcttccttttttaaagctgagctctttgggaggagtgaattccttaggcgtatcctccttggagcacatcactcacagcctcctgggacgccctttgtctcggcagctgatgtctcttgttgcaggacttaggaatggagctcttttactcacaggaggaaagggaagtggaaaatcaactttagccaaagcaatctgtaaagaagcatttgacaaactggatgcccatgtggagagagttgactgtaaagctttacgaggaaaaaggcttgaaaacatacaaaaaaccctagaggtggctttctcagaggcagtgtggatgcagccatctgttgtcctgctggatgaccttgacctcattgctggactgcctgctgtcccggaacatgagcacagtcctgatgcggtgcagagccagcggcttgctcatgctttgaatgatatgataaaagagtttatctccatgggaagtttggttgcactgattgccacaagtcagtctcagcaatctctacatcctttacttgtttctgctcaaggagttcacatatttcagtgcgtccaacacattcagcctcctaatcaggaacaaagatgtgaaattctgtgtaatgtaataaaaaataaattggactgtgatataaacaagttcaccgatcttgacctgcagcatgtagctaaagaaactggagggtttgtggctagagattttacagtacttgtggatcgagccatacattctcgactctctcgtcagagtatatccaccagagaaaaaattnatttttaaaaacntttggaatttcccaaaaaggggcccccccggaattncttcc

SEQ ID NO: 370376 - DNA, 360 bp, Homo sapiens
agtaatatatagatacatgggtgatacaaatgtttggggccttgtagataatgtagaaacagcatgcaacctcaccgctcttgctccacggagtccaagtgtctgaaaagttgataatacatcaaattagaactgacttggtagaccagggaaatgagatagctggtaggacactgtcatcacttgctataatgagtgacctacttttgatcctatgtcaacttcagtgactaggtgaaaagctactgaattgtgtcctcatctcaaatgtatttttaaattagtttgtgctgtggtacttctgattaattttaaaatggagcttgtctctaggccagtgacccttaagtctgttatgtg

SEQ ID NO: 370377 - DNA, 335 bp, Homo sapiens
ctgttgagagctgctgctcaggaaaaaatattcctttcaaaatagttttgttctatgacaatgcacctggtcgtccaagggttctgatggagatgtacaaggagattaatgttttcatgcctgctaacataatatccatactgaaactctttattatttaaggaatacattttataaggctatagctgccatagatagtgattcttctgatgaaccggggacaagtaaattaaaaacctttagaaaaccttctccatcaggatttgttgcttttgaaatctgggtcaagtaaattaaaaaccttctagatgccattgggaacatttgtgattcat

SEQ ID NO: 370378 - DNA, 452 bp, Homo sapiens
agttaaaaagaatttaatgaaatgagctcctacaaagggaagaaggagaaaggaactaactagggaagatgaagcaagcacacaggaactaaccccaacaaaaagccattactaccttttggtctaaagaatcatgaggagggaggctgctgccggaatccagcaagagctatcgccatgttggaggggatcccgggtaagagctacagccttgtaggaagtcataacctctgcaaaacaatgccacaacagacaggattggaagacagaaggatataggtaccctgggctctctcctcttaccttcagatttcttgctggtaattattactgaaaccctggaagtcagaagctaaggaaacccaggtgatgaagttcatagtgttcttcctcttggggcaaaagaaggcaagagactaatgaagaggggaactgaagagaataaaaaaaaa

SEQ ID NO: 370379 - DNA, 155 bp, Homo sapiens
caaatgctggggttacaggcgtgagccactgtgcccagccgcagagttcatcttgagaccctgacttctgccagctctgatcctagtgggtggggctctggggctcagtgaaacagtcagccgttttgcttcagagaacacaaataagattttgg

SEQ ID NO: 370380 - DNA, 4143 bp, Homo sapiens
  misc_feature (246)..(246): n is a, c, g, or t
  misc_feature (1120)..(1120): n is a, c, g, or t
  misc_feature (3870)..(3870): n is a, c, g, or t
cagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccagccngatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccagagcgaccagtgggggatgtggactgggcctcgggcacctccttgcaggactccggccagaacaggacngttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaagggggaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcaggtatgccctctcctcttcctcagccccatggctggggcggccttagcaaacaaggcagggccttctggctgtggtcagaggcttttctggtctttggctgagccgtgcagctctgggaattcagaaagcctctgactacaggactaggcttctcccctcaggggctctttctgaattgtccagggctctctaggagtctgcacctgcagagcctttgccctaggcaactgcagctgagagtgcgttggtggggagtgtgcgggagggggtagagttggcaggtttgactccactgtccccctgctgtctgatgacatcttgaaattagaagcttaggccgggngcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatctc

SEQ ID NO: 370381 - DNA, 4130 bp, Homo sapiens
  misc_feature (246)..(246): n is a, c, g, or t
  misc_feature (1120)..(1120): n is a, c, g, or t
cagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccagccngatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccagagcgaccagtgggggatgtggactgggcctcgggcacctccttgcaggactccggccagaacaggacngttggtcccaacccggagcctgtgctgagccccaggcatgaggaagccacgcatctgctgcagcgtgcccgcatgaaggccaggacccggcccctccgtgccagccatgacatcgtgcccaccattacccagggcagccgagatggccacagaagcccagcccgggaccccaggacgacccctgcctgcagagacagcctccagaacgggcacacgagcgattcctccagcggagagtccagcggtgggcacaggccgaggcggggcccctcgccgtcgcacgtgcgctttgaggatgagtccgcccgcgaagccgagttccgtcacctggagcggctgcagcagcgccagcgccaggtgctgagcaccgtgttgcaggccgcggaccagggccccctgcgctccaagcccgacctcgccgactacatcaacggggctccccggctccgggacgcggggcaggggacattccacaggcttgtgggcagcctggaccgcaggggacacccggcaccgccggcaccgggcagcgagaggaggtgccaggcctgcggcagctgcatcgacgacccgcgccccgcccaggggaaggcgccccccgtccccaggaccctccaggagctccaggctgcctgtgggatggagagggtgctgggtggcctgagctccccactccggctccttcctgcagagccccggctccacatggaatggatccgggaaacacacatcggagacaccgtgtgccctgcggaggtggactctgccctggacagcacagacaactctgacaactgcaggaccgacagtgaggaggcggggacctctcaggctggctgggcgtgtgggcggacccaaggcagcagcccgcgactgcgactgcggggctccaggcctcgaggccacaggtggtccaagaaggctgaggcggagctcccttggggccttcaggcccagcaacacctgcctagggctgatgatgtggaggtggaaaatgaggtgaaagagggcagaggacacacgcctgaaggaactctatttttgagagaagatgccaagcctcctgacctggagttgaagcgggtgtccctgggaccccagtggcagcctggaccagggctgggaagtcaccagcctcaccctttggattcccggactccatgcaggacagcctatgccaccaccgcccccatgacgcctgaatcatcggggccaggaggccaggcccaggttacagaaagccacgagtccctggaaattgtctctccttcctccctgcaacagagccatgcagagccttctgccccacaccaagcctggcagccaacagcttccttgtgtcctgaaggctgggcgccaacccctcccccttcgaggaaaaccacctcgccagtgtctcacaggaaggcagccctggctggactgctcaggctgggtgaccagacagagcctgtgggtatccctcggcctccttcaagaagcgcggttctcaggacctgtgagctgcccccatcacagacccagcccagccgccctcaggtcaggcacccactgctggccctgtccaccaacaactgcaacaacagcgcacctcgggggctgcaggagccctacgggggagccgtccacgagggtagggtggagaggggcccctgcagccgggaaccggagccgcccctggagaacagcagagatggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaagggggaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcagggatctacgtgcaggagatggctgacatgagcatggccaagctgtactcagggctgctgggggtgggcgatgagatcctcgaggtgaacggggccaaggtggcagggctgggcttggctcacattaaggagctcctggcccactcagagagcttgtcaatccgtgtcctgaggcagagacctgtcccacggtgacccagaagtgccgctgccctcactgtcacggcctcggaagccctgaagcactcagggtggttggcaggaacgtgctgcacagagctgctctgtggcggaaacagatcctggcagcatctaaccccttgggctgtggcagggcttctgtggtgggctgcctttgggagacgcaaggagcctgtttgcatattttgtttaaggccatttatccagaactagaaaaagaaaaaaatgggtctccttccatgtctgagggggtgtcaacatctacttgtacctttgttggcagggggagaagggagattcagtggatcctttggttgatgcctgagagccggcctcacctcctggtcccatgcctggtcaaaggctacagcctccaacactgtggaaccaaagaaagcacatg

SEQ ID NO: 370382 - DNA, 2574 bp, Homo sapiens
  misc_feature (246)..(246): n is a, c, g, or t
  misc_feature (1120)..(1120): n is a, c, g, or t
cagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccagccngatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccagagcgaccagtgggggatgtggactgggcctcgggcacctccttgcaggactccggccagaacaggacngttggtcccaacccggagcctgtgctgagccccaggcatgaggaagccacgcatctgctgcagcgtgcccgcatgaaggccaggacccggcccctccgtgccagccatgacatcgtgcccaccattacccagggcagccggaggaccccagggctttcttggctcagcagatgttgccaccatcaactccacgggcatcaccctctccctgtcctcagaggagtcagagtccagcaaggaatcagagggaagcctgcagaggacagggtcaggatctggaggacatgtgctgtcaagagcatcagcaggagctggcacaggacccggctccccctcggctgcccctttggaccagaacaagaaaaggagcagcagcatagcctccaccctggggctgaaaaagctcttctcagccctgggccagagttcccggcccaagctgggcaagtcccgcagctacagtgtggagcagttgcagcccgccccgcctggcctgacgtcacagtccagggccccatcgttacaatccctgcacccggtgtcaccctctcaccagcgtcggaaagctgcctcttttcagaacctccattctctgctgagcagcaagggggaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcagggatctacgtgcaggagatggctgacatgagcatggccaagctgtactcagggctgctgggggtgggcgatgagatcctcgaggtgaacggggccaaggtggcagggctgggcttggctcacattaaggagctcctggcccactcagagagcttgtcaatccgtgtcctgaggcagagacctgtcccacggtgacccagaagtgccgctgccctcactgtcacggcctcggaagccctgaagcactcagggtggttggcaggaacgtgctgcacagagctgctctgtggcggaaacagatcctggcagcatctaaccccttgggctgtggcagggcttctgtggtgggctgcctttgggagacgcaaggagcctgtttgcatattttgtttaaggccatttatccagaactagaaaaagaaaaaaatgggtctccttccatgtctgagggggtgtcaacatctacttgtacctttgttggcagggggagaagggagattcagtggatcctttggttgatgcctgagagccggcctcacctcctggtcccatgcctggtcaaaggctacagcctccaacactgtggaaccaaagaaagcacatg

SEQ ID NO: 370383 - DNA, 536 bp, Homo sapiens
taactctaaagtggtatttattactgtataataaacttactttcatttcttccttaatgagtacattagatttccttaatcaatgaggaaattagtatagcactaaagttgttatttcagctaaaaagcaaaacaaaaactcccttgactcctcagatggcctatgtagacccatgatgtccttgagtaagtcatggtggttcctgttgaattcttggaagcaatgataaaagcttgtgctgtcactttcttacagggccctcaggttcatggtggggccaagtcctctgtcagcacctcccaggtagcttttctcacccgcaatattgtccctttctcatcaggtgtcaccctctcaccagcgtcggaaagctgcctcttttcagaacctccattctctgctgagcagcaagggggaccggtccagcctctacctggtagcagggccaggggaccacagtgcagctggcaggtatgaggggcacacatggtttggaggataaactcagagagtgaccagcggagccaaaagctta

SEQ ID NO: 370384 - DNA, 1260 bp, Homo sapiens
taactctaaagtggtatttattactgtataataaacttactttcatttcttccttaatgagtacattagatttccttaatcaatgaggaaattagtatagcactaaagttgttatttcagctaaaaagcaaaacaaaaactcccttgactcctcagatggcctatgtagacccatgatgtccttgagtaagtcatggtggttcctgttgaattcttggaagcaatgataaaagcttgtgctgtcactttcttacagggccctcaggttcatggtggggccaagtcctctgtcagcacctcccaggtagcttttctcacccgcaatattgtccctttctcatcaggtgtcaccctctcaccagcgtcggaaagctgcctcttttcagaacctccattctctgctgagcagcaagggggaccggtccagcctctacctggtagcagggccaggggaccacagtgcagctggcaggccggccaagacttcaccacggcgtgccctcagtgtggaggacgtgggtgctcccagcctggctcgcaccgtgggccgcctggtggaggtgttcccagacggcaccagccagctgcagctgcagcgctccccagggggcactttcggcttctgcgtggcctctgggaatgggcgcccagactcagggatctacgtgcaggagatggctgacatgagcatggccaagctgtactcagggctgctgggggtgggcgatgagatcctcgaggtgaacggggccaaggtggcagggctgggcttggctcacattaaggagctcctggcccactcagagagcttgtcaatccgtgtcctgaggcagagacctgtcccacggtgacccagaagtgccgctgccctcactgtcacggcctcggaagccctgaagcactcagggtggttggcaggaacgtgctgcacagagctgctctgtggcggaaacagatcctggcagcatctaaccccttgggctgtggcagggcttctgtggtgggctgcctttgggagacgcaaggagcctgtttgcatattttgtttaaggccatttatccagaactagaaaaagaaaaaaatgggtctccttccatgtctgagggggtgtcaacatctacttgtacctttgttggcagggggagaagggagattcagtggatcctttggttgatgcctgagagccggcctcacctcctggtcccatgcctggtcaaaggctacagcctccaacactgtggaaccaaagaaagcacatg

SEQ ID NO: 370385 - DNA, 429 bp, Homo sapiens
aatcacttctctttttgctagaatcattttagttgctattggtaggacttactctataacagacttgacttgcttttgctgcatggctactgcttatttatgtaaatgttctgtactgccatctcatttccgtttgctgcagctattctttttctatattccctccctatttttctttttcatcccttctttctctacctctgctgcagacccaccagtcttgattttcataatcactgcgtcagttcctgaagttcccttgaatttaggatattttcattgtgtacatcaaacataaaaattatttgaactgtatccatcctgatttgaatttgaaagactgtcagtagtagttatctcagacctctgaaaaatgccagtaatatgaggcatttctgtttcttaatactattttatatgtttttactg

SEQ ID NO: 370386 - DNA, 817 bp, Homo sapiens
gagaggttgaatggcatgctcaaagtcacaaagctggcatggggcggggctggaactcaagagtcagacagtctggctccaaggcctggagatcccaggctgggccccagatttaattcagcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcggtgagtggagaggcacaatgccactccccttcctgaggtgggggtaggggaagggagtcccacaatgcagttacaaacaggatggacaagaacacctgctcaggagtcagacttacagggttcaaagttctgctccaaggtttgaccctaacaagaatcacttagtaataagtggttatgctctgtgaccttgagtaaattacttaccctctcaaaaaaa

SEQ ID NO: 370387 - DNA, 589 bp, Homo sapiens
gtgtttttaaagccaatagaatgtttcattattgttagcttcactgaattttattattccttaactattttactctcttgtaggagatctatgcttgtgaattagctaagagatctggagtagctaattacataaatttttatgtatattcatgtcagtgtataggtgacatttgcgacacaagttctaggtcattgttttggaaactatcccagttcgtgtaacatatatccatcccattcaggaagcatctgggtatgtagctgcatggcagccctctccatgccctcttgtaaaaatcccttaatggtgcattatcagttgtgttataggaaacctgcttaaaaggtttcatgaatcataaaacattatgaaggctattaaatttttaaaatagtatttgggaaagggggaagtccccaggaaatcctgatcttttccaacttccctctctactaaaatctttttggaaagggacctaatgtttttcataaccggggctgaagggaggacttctgacttagttttggctaccagatctgaattcctcatgctccaagattctctgatctctttgagacccttttgc

SEQ ID NO: 370388 - DNA, 414 bp, Homo sapiens
aatggcgtgatcacggctcactgtagccttgaacttctgggttgaagcaatcctcccacctcagcctcctgagtagctgggactacagatgtgcgccaccacccctggctagtgtttgtatttttttttgtagagatggggtttctccatgttgcccagtctggtctcgaactcataggcccaagcaatcctcctgcctcagcctccaaaagtactgtagaaatacactttttaaattaaaacaggcaggttgaatggggctcaaacctaaggatttagtttttaggctctatgatgtagaaaaacatctgtttcttcgatattaccaaaacctcagcatattgtatagtataatacttggttatagcaggcatttaaaaacagtaaataataaaaacaataagagctatcaaa

SEQ ID NO: 370389 - DNA, 160 bp, Homo sapiens
ttctttattttctgttttctaacattagttagggaatattagttgtgcttccacacaccagtaagcccaaaataaatcagttccttatgtaaacaaaatctagtagactatagtaattcatctaagaaaaacgaatctccttctgtagaatagttacact

SEQ ID NO: 370390 - DNA, 4170 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctcactgcaacctctgcctcccaggttcaagtaattctcctgcctcagcctcctgagtagctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370391 - DNA, 2850 bp, Homo sapiens
gcgaaccgagaccagcggacacgctgctgttcgacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370392 - DNA, 4310 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggtgaggctccctcggaggggcgacagggaccgggctcagatctgccaaatgctgcggaggcagaacctgacagtgcgggagggcaggcgcctgggaggtaggagctggtggagatgacagcgtggaactcgtgagccccacgcaacgcctccccgccgcccaaggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370393 - DNA, 4523 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtgagccccaacccaagcccacaagtgcctggggagcccatctggtagtggggggtgttcagggcttcatagctccaggctcatcccatccccagctacagactctctcctggccatccaggtcatgaggatctatgatacccagaaggaaatggacagagaggcctcccaggctgctctgcagaaaatgttaacgctgctggtaaggctcctggggtccctcgccaatggagacgggctcctctcctgtcctgagacagaggaaattcaacccccagatacccttcctatgtagtgacccccatgagcaaaggcctgggtgtgtgtgtttaggggtggggtcacctcagagcctcgcctttgctcccccttcctgtgccatccccaagcccgagaccacctcctccctgcccctggcatccagtctaacctgcctcttcctgatccacctggggtagatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370394 - DNA, 4098 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370395 - DNA, 4613 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggtgagacagcacacccctgcctcaacctccccgattgggggacttgtgcccatccagtgctctcctagtctggggtgacctcatgagcacacccgcatccttcatcacatgatggccccttccccagctccgggacccactcagacagggtgggggtgcatggggcagtggacacgctctatctctccagtctacctggagggtgggcgccagtgctgtgccaccgtcagggcctccctctcagagagagggacacaacagagctggctgccctcccccaacccccactggtgctgacactagccagagggagcttatttcctgtttctggaagcctccccactcattccccaagcccacctggcctgcttggctgccttgcctgaccagactcagggtgctcaggtctgggcttcgggggcccagagtgaccctcatactgccctgctgggatggcatgtctacaggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370396 - DNA, 1495 bp, Homo sapiens
gtatcttatcaccatgggtgaggcaagaagtcttcagggggaggggccaccgtgtcatgggctgtccaccccacaggttcccgggcccctgtgtacttctacgagttccagcatcagcccagctggctcaagaacatcaggccaccgcacatgaaggcagaccatgttaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370397 - DNA, 1804 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagcccctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370398 - DNA, 534 bp, Homo sapiens
gtttctttgggggcaactacagtgagtcttcttcctttcccgggaggtgggctgggattctggctgggtctctgagcgatgattgattgtcctcactgcccagataaggaaactgaggctcagagagaggatgagatcaggtgtccaaggttttatagctccaaaagctgcaccaggattagaattcacgactcttcagactgtgagctgtgctccctctgcctctccccagccatgggtgtctggcctggtgcagaacaggtgtttcagggacatgtttatttcttcagtgactcccagagatagaaggaagaaggggcctttggggccatgaaggagcccaggatggagtcagccagagcctggtctacagggaaagtttggaaaaggggagggctggcttctgagggcagtggaagaaaaagcggagaagcaggactggggaccgaggtctcgggggccaaggacgagctccacctgggatgctgaggttggacatcctgatgaagacacatgtcctcttcctcttggcag

SEQ ID NO: 370399 - DNA, 4146 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370400 - DNA, 3562 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaaaaaaaaaaaaaaacttcgggggctttattttcggggtgggggaaaaagggggttttgaaaagtgggccattgggccataagttgtgttttcttggaccccggtttttttgtgtccaggggggaaaaatcggggggcccccctaaagggggggcgaaataatttcggaaaagccagggtacctcgta

SEQ ID NO: 370401 - DNA, 2863 bp, Homo sapiens
  misc_feature (8)..(9): n is a, c, g, or t
actgttgnngcctactggaaattaaaaaaaaaaaagagaaaaaacgacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370402 - DNA, 3229 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccagggcaacacagtgagaccccttctcaaaaaaaaaaaaaaaaaagagagagtgtgtgattagaagctaaataggaaagttttgagcttcaagtcagtgaggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccagctactcaggaggctgaggcaggagaattacttgaacctgggaggcagaggttgcagtgagctgagattgtgccactgtactccagcctgggcaacaagagcgagactccgtttccaaaaaaataagagagaatagaagaagctactgcatgatgttagttaccaagcctgccatgggtcctctcttgctagacacactccatagatccccccactgagctgtggatgggcaaaccccggtggaatcccaccctccccaacaccccactgagccctgggccccctcctcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370403 - DNA, 3255 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctgatgttgcctcctacatttggtgacctgctgagggaggagtacattggggacaatggggatccccagaccctccaagcgcagttccaggagatgatggcggactccatgtttgtgatccctgcactccaagtagcacattttcagtgttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctcccttcccttcctcacctccaccttctccctgccttctctcttctctcgtctgagcccccaggccttttccactttgagggaggtgcttcgaagaatgttgcccacacctaagtgttagaagcctatgtccgttcatccctgagaggtctgaaagaataaaaataaattctaaaaa

SEQ ID NO: 370404 - DNA, 3236 bp, Homo sapiens
gtcgatgctgtcgggaacctgctcgtcctcctcgcctgccgtcacaggccgctccccagagcgctggtagatgagggggttggcattctccaggaggccgccgccgaccccgccgccgcctaccatcgcggaaccaccaccgctgatcctagcaggcgtgcgcttccgctccaacccgcgcacttccggagaacgggaagggggcgtggcgtggcgacggagtcgcgcgagggacacgccgcgttgtgggttctcggcctgaggtgcgagagaagcggtgaccgcggccctggctgctcggacccgggaacatgatggtcgctggagcagaaggcgctgagaagggaccacggcggcgctgggtcgtgcgagccagtagcgggctgaaacgtagaggccagaaccaggtctcagggggcactaaaggcggtcggaggtaatccccacaccgcttcctcctggaagtcaggctggccgggagctcccgtatccaggacggttggtcgcctctggcctggcagggatcctagtgtctcgggacctcccggtgacgcgcctgcctcccctgctgcaccataggcccgggagtacggcgtccccacagcttggaccggcaggggctcgtgaaatgtttgtcaagtggataaatgaccatggccgtggtctccgcgggaggtgaggaaactgaaagccaccgaggaaaaggggggcgctccttaagaagtgccgcggtcacgtgtacgtttcaaaagaatggcgtgactgagtagggaggggaccgcggagaccctcagaccctggactgtaaggagatgaggggccgtgaaggggaacccaggaaactgagtcctgaaagcaaggaggaacttccagaatgaagggcgccgacactccttcctgcctttgctcaagcggttccttcaccccgatcaagttccttcccatttctccatctgggggatcctgaacgtgcacatcctcagagaagccctcctggggtctccaattctagtttattgccccctcctatcgatcccccagcgcgctcatcgggcctgtggacaaggacaggtttgaagagaggattccctggatcgcggaagggctgcaggaatggcacagccccttccgaggatgccaaaggagcccgggcaaaggaaagtggccgtgcccgggcctgcctaccactagatccccacccacctatgactgctcagtcccgctctcctaccacacccacctttcccggcccaagccagcgcaccccgctgactccctgcccagtccaaactccaaggctgggcaaggcactgatccactgctggacagacccggggcagcctctgggtgaacagcagcgtgtccgccggcagcgaaccgagaccagcgagccgaccatgcggctgcacagacttcgtgcgcggctgagcgcggtggcctgtgggcttctgctgcttcttgtccggggccagggccaggactcagccagtcccatccggaccacacacacggggcaggtgctggggagtcttgtccatgtgaagggcgccaatgccggggtccaaaccttcctgggaattccatttgccaagccacctctaggtccgctgcgatttgcaccccctgagccccctgaatcttggagtggtgtgagggatggaaccacccatccggccatgtgtctacaggacctcaccgcagtggagtcagagtttcttagccagttcaacatgaccttcccttccgactccatgtctgaggactgcctgtacctcagcatctacacgccggcccatagccatgaaggctctaacctgccggtgatggtgtggatccacggtggtgcgcttgtttttggcatggcttccttgtatgatggttccatgctggctgccttggagaacgtggtggtggtcatcatccagtaccgcctgggtgtcctgggcttcttcagcactggagacaagcacgcaaccggcaactggggctacctggaccaagtggctgcactacgctgggtccagcagaatatcgcccactttggaggcaaccctgaccgtgtcaccatttttggcgagtctgcgggtggcacgagtgtgtcttcgcttgttgtgtcccccatatcccaaggactcttccacggagccatcatggagagtggcgtggccctcctgcccggcctcattgccagctcagctgatgtcatctccacggtggtggccaacctgtctgcctgtgaccaagttgactctgaggccctggtgggctgcctgcggggcaagagtaaagaggagattcttgcaattaacaagcctttcaagatgatccccggagtggtggatggggtcttcctgcccaggcacccccaggagctgctggcctctgccgactttcagcctgtccctagcattgttggtgtcaacaacaatgaattcggctggctcatccccaaggtcatgaggatctatgatacccagaaggaaatggacagagaggcctcccaggctgctctgcagaaaatgttaacgctgctggttcccgggcccctgtgtacttctacgagttccagcatcagcccagctggctcaagaacatcaggccaccgcacatgaaggcagaccatggtgatgagcttccttttgttttcagaagtttctttgggggcaactacattaaattcactgaggaagaggagcagctaagcaggaagatgatgaagtactgggccaactttgcgagaaatgggaaccccaatggcgagggtctgccacactggccgctgttcgaccaggaggagcaatacctgcagctgaacctacagcctgcggtgggccgggctctgaaggcccacaggctccagttctggaagaaggcgctgccccaaaagatccaggagctcgaggagcctgaagagagacacacagagctgtagctccctgtgccggggaggagggggtgggttcgctgacaggcgagggtcagcctgctgtgcccacacacacccactaaggagaaagaagttgattccttcattcacttcgccattcattcatacttccgtccatccattcagaaagcatttattaagaatttactcaggcatgatggcccatacttgtaatcccagctattgggaaggatgagatgggaggatggcttgaggccagaggtttgagaccgaccagccaggcacaacagacgtgatccggtcgcttgtgtttgctggccggcgtgct

SEQ ID NO: 370405 - DNA, 464 bp, Homo sapiens
ttcgagaccagcttgggcaatgtggtgaaaccctgtctctgcaaaaaaaaagtaaaaaattagctgggtgtggttgcgcatgcctgtggtcccagctactcgtttgagcctgggaagtcgaggctgcagtcagctgtgattgtgccactgcactccagcctgggcaacagagtgagaccctgtctcaaataaaaaaaaaaaaaggctgagataggagtgatagacacagttatggggggcatcccacataatggagagcatccaaggccatactagactgcggaagtggggtgctgatatttgtgagatatttgtggccccctgctcatatcagtggtctgactttttccaatgtggcctctttcaagaggcaccttgattagactcttgagtcatcttagagacattagctgcccctggcatgaaattgcaatttggcccatagattttccaggaaaaaaaaa

SEQ ID NO: 370406 - DNA, 2876 bp, Homo sapiens
acgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctcgagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370407 - DNA, 2043 bp, Homo sapiens
gagtaacccgataatatgccgttgtgcacggcgacgagaattcccagatatagcagtagcagtgatcccgggcctgtgggctcggggccggggctgcagttcggaccgcctcccgcgacccgcggggccggctcggagacagtttcaggccgcatctttgctgacccgagggtggggccgcgcgtggccgtggaaacagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370408 - DNA, 3285 bp, Homo sapiens
acgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctcgagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacacagccgtgcttatgtgcgtatgtattgtctgactgcttttgcaaaacggcagagttcaatagttgcacctgaaaccatttgacttgacaagccaaaactattttctggccctctgcagaaagggtttgctgacctctgatttagactagcatctaacattgatttgcccacatattgaaagggtcagtggagttttcatttattattttttatttttttgagattgagttccaggctggagtgcaatagcgcaatcttggctcaccgcaacctccgcctcccaggttcaagcgattgtcctgcctcagcctccccagtagctaggattacaggcatgcaccaccacgcctggctaattttgtattttcagtagagacgcggtttctccatgttggtcatggctggtctcgc

SEQ ID NO: 370409 - DNA, 2177 bp, Homo sapiens
acgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctcgagcccgcagcccccagggcctgggacgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370410 - DNA, 2729 bp, Homo sapiens
acgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctcgagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggccaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370411 - DNA, 2135 bp, Homo sapiens
ttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370412 - DNA, 2873 bp, Homo sapiens
agcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctgtccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgccccggcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctttgctgacccgagggtggggccgcgcgtggccgtggaaacagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370413 - DNA, 2573 bp, Homo sapiens
acgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctcgagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtt

SEQ ID NO: 370414 - DNA, 2088 bp, Homo sapiens
  misc_feature (22)..(22): n is a, c, g, or t
cctccgagaacggtgtccatgncacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatggagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370415 - DNA, 2393 bp, Homo sapiens
agcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctgtccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactgagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagaaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaacattatatgaagtttaaattctagtgtccataaataaagtttcagcggaacaca

SEQ ID NO: 370416 - DNA, 547 bp, Homo sapiens
aagcactggtatcaacgcagagtggcattacggccgttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaattagctgtggtgggagatcgcttaaacccaggaggtggaggttgtagtgagccaagattgcaccacggcacgctagcctgggtgacacagcaagactccatctcaaaaaaaaaaaaaaatttcctttcaacaaggcattatagtctctgtgtaatatatttctgtttacctattactttgtccagaatctgtacttatgttgggtgtgtaatataccaattagtttatataatatcctcataagctattctaattttggagagaaacacaaaaggttatagcatggatacgtctgtatacattttagaca

SEQ ID NO: 370417 - DNA, 1036 bp, Homo sapiens
actcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctggtaattccagcactttgggaggctggggcaggcggatcacctgaagtcagagttcaagaccagcctggccaacatggtgaaacc

SEQ ID NO: 370418 - DNA, 3914 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370419 - DNA, 3543 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccgttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370420 - DNA, 3823 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgtgtgtgtttttgtttcagaacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370421 - DNA, 3858 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcactttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370422 - DNA, 3482 bp, Homo sapiens
attggttatttgtcatacggcagtggtgggggatggatttaccagaaagatgatcagcttataattcagagagtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370423 - DNA, 3408 bp, Homo sapiens
aaaatattggtttgactggcatgtggctatgaaaagagtgaaataagaaagagattctatgcttcatgtattacatcaaagttaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370424 - DNA, 2986 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttctgctttaggataaggtaagtagactttagactataaacaggttatctaacaagtttacccccctaggtgaatatccaaagttgcaacccttgcaaaaacagttctgacgaacccaccaaggcctctactggctacccagtaggacgagtatatccccagcgcttagggcatgacatagcgcattcatataccatggacaccggtacactcaacagcataacgcgaa

SEQ ID NO: 370425 - DNA, 932 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaagaattcaaggacgaagatatcaatgaccagcacagagatgtaatcttcctctcggccacacacctgggtgtttcccttatttttttgctgcgtgtttccttcatgtcgtccaatttcttttcttattctcatatttggctagatttttaataccagatctatgtcagctccttctcaaacctaaaattcagagccccagctctgttgagcgtgtattatatttcagttgctttatacatgttatctcataacagcaaccttaggaggtaactattgttattaccattttacaggtgaggaagctgaga

SEQ ID NO: 370426 - DNA, 3946 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370427 - DNA, 3716 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370428 - DNA, 3815 bp, Homo sapiens
ggtttttggcggctgcggcccccgggccctgccccgagtgcagaaatggggaaccgcgccggcccctctgcccagcgcaatgggcggaactgaagtcccgaggggaagctttgtattgggggtgcaattgaaggcggttgatggtgaagccattctgagtttatgtgttgactccggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370429 - DNA, 3859 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcgggtggatcatgaggtcaaaagattgagaccatcctggccaacatggtgaaaccccgtctctactagaaatacaaaaattagctgggtgtgggggcgtgcgcctgtagtcccagctacttgggaggctgaggcaggagaattgcttgaacccaggaggcagaggttgcagtaagccaagatcgtgccactgcactccagccttggtgacagagcaagactccgtctccaaaaaaaagaaaaaaaaatttcttgaagtggaatgatgtacaccaaatacccactttatagataattacagggatggtgaaaaattagtaaatagcttcacaaaagaggcagcgtgatacctttagtgttttctagaatttttttctggatattatatgtaagaatttattgtttgagggaaatacgaggtttcattgtttaaaatcaagagtgtattgtttactgttttacagtattatttaatatccaactggtctccaatctccattacatagggactgtacagagcctgtgaagatgtatgaatggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaaaactgcctagggcaggattcattagggcttgcagacaatgtcacctaaattgctgaatgtactcattataatatgatatctgacaaaggtagtacagcgtttctgagtcatttgggaccaactgcagtggttgtttaaaatgctggttcctgcacacaattctctatctactgaagcacatctgttttctttgtttgttttgctttgctttttgtttttaaagtttcccccagtgattccagtgcacctgaaaagttgagaaccacaggcttagtggtacgttggggtttcccacgctaggctgcatagcattataacctgggaacgttaaaaaaaatacagacattcttgattcttagtgtagttatgatgtggatcctacgtattttttaaaaaactctccagataattttgatgtcacgagtcactagtatagactatctatctagtgagttgtattataagcgatgaaatactttaaaagctacccagtaactcttgggattaattttatgaaataaattctgagctgctgcttttgatatagtcagacttaagactgaaccccagtagacaggcaatagatatagaattctggttagctaattgaacttttgtgacctgtttaaaaacaaatcaaatttattgaacaaatgacaaggcacaaatactttcagaattgtatttcagttttgaagatttaaaaaaaatgtgaaaataaatatatattagtatcctttattttaaagtcaattgtaaaccagaagtactgttattttggtgattaaaatccaaaactttagctgtatttcagtaacaaaaacataccttactagactgtgatggctcacacctgtaatcccagtgctttgggaggctgaggtgggaagattctttgagcccaggagttcaaggctgcagtgaattctgatcgcaccactgaactccagcccgtatgacagagtgagaccctgtttctaaaaacaaaacaaacaaacaaacaaacaacgtatcttactgactaaactggaatggaaatcttataattagtgttgtatttttctgcaaaatagtgaattggtacttgggagacttctgttctttgttgaaaaaaattgcctttgttttgaaattatatcacctgtgttctgaactaaaatgatgggagttcattttgtatttactttgcagtaagtatcatgtaaatatgcaaatgttgaatgtaatatagattgtgtcctcattgagtttttgggtgatacagtttataaatataacaattatacaccctcatacattcgtctgattttgagcttgtaagatgagaactgctttttacacatttaataaaaaaaggtctctgaattatctga

SEQ ID NO: 370430 - DNA, 2059 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctggtttaagtgacacttctccagatgaagggttaatagaggacttgactatagaagacaaagcagtggagcaactggcagaaggattgctttctcattatttgccagatctgcagagatcaaaacaagccctccaggaactcacacagaaccaagttgtattgttagacacactggaacaagagatttcaaaatttaaagaatgtcattctatgttggatattaatgctttgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttttggtgagaggaagtgatactctttattacaagaaacaaggaattaacaaaaataaggaacttgttgctacctttcttttctgttgaacattaaaaataatttggtttgtggactgggcatggtggcttatggaaaagaggtgagcctttgtgaagaacataatggaaaagtgcatgtacgggaaataacagcactttaggtgtagttcaggtgagcaagatgccagatagtttctactaaccatatactctttctgcttcttagcgtcgttgtcactgcttctgtggcttttgggttcaaagtagattatatatattcctaaagcttggtggaggtagtggagctatcacacactcaaatgagcttgtatatttataatacaatatagtattatagtaacagttatcatacactgagatatagtttctgtgcttgtaaaaaattcttgaagtgaggccgggtgcggtggctcatgcctgtaatcccaacgctttgggacgccgaggcggggtttctccatgttggtcaggctgatctcaaactcctgacctcagatgatccacccgccttggcctcccaaactgctgggattacaggtgtgagccaccgcgcctggcctattctgagttaatttttgtggaggcttgtaaggtctgtgtctattaatagatgcatttctttgcgcatggatatccagttgcttcagcaccatttattgttgttgttgttgtttgagacagggtctcactccagccttggtgacagagcaagactccgtctccaaaaaaaaa

SEQ ID NO: 370431 - DNA, 1164 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggacggggccctgacacggccaccctactgcctggaggccggggagccgacgcctgtttgctgaggctaaacactatcatgccaagttggtgaatataagaaaagagatgctgatgcttcatgaaaaaacatcaaagttaaaaaaaagagcacttaaactgcagcagaagaggcaaaaagaagagttggaaagggagcagcaacgagagaaggagtttgaaagagaaaagcagttaactgccagaccagccaaaaggatgtgaaaagttgtgtttgtgtgttttcttctcctgtcccatatttgggttatgatgactcaagtgtagactgaagttgaggtagtgccttatgccattatgtcatatgttgaaatccttattccggtattactgtgtctccatgccttttttccaagtagcagacgtcatgttgcatggtttttgatatttatatgtaagtttttcaaattttgcttaattttaaaatttattattttgatcttgaattatttataaactggaaagtggtttgattattgtgagtcaaaactctaagtggttaaaaattagtatgaattttttagcttcttaatgaatatggatttaaaactctccagttcttattttatgaaatgacttgcctttctggtaatacaatgctgattttttagtaattgccttttcattactttgttaagaagaaatgccagctgtttaatcacacctacccctggaaaagaggtaaaccttttgaacagttgaatttcatcagaagctctatagctttgggggagaaggggaccctttttccgaacaggggttccacatagggcgggggccccctttcgggcgctacaaagggtggggcgggggggcggaaaaggggtgggacaaaaagggcggcgaccctgttg

SEQ ID NO: 370432 - DNA, 727 bp, Homo sapiens
gttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatccttttttaaaaaatagtttttcagataatattaaagattttgaactct

SEQ ID NO: 370433 - DNA, 790 bp, Homo sapiens
gttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatccttttttaaaaaatagtttttcagataatattaaagattttgaactctagacagatggccttatagatttggaaaatgagtacttgactgaaatgaaatataaataaaata

SEQ ID NO: 370434 - DNA, 673 bp, Homo sapiens
gttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatagaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgttatatgtatgtactttattgttttatgtaacattttaaatttgtgcatttcatcactcttgacatgttcttcaatccttttttaaaaaatagtttttcagataatattaaagattttgaactct

SEQ ID NO: 370435 - DNA, 605 bp, Homo sapiens
gttctcagagagagcaagggtcaacattatctccctggggagaagttttgacacctctagcaagctcttctgttactcacttaagtagtaaacaggaagaatatgttaaggttgccaaaacactttttactgatgaagcattaaaaccttgcccaaggtgccagtcccctgctaagtaccagccatataagaaaaggggactgtgtagccgaacagcctgtggttttgacttttgtgtgttatgtctgtgtgcttatcatgggtctgaagaatgtagtagaggagcagcaaagccaagaaatagaaaagatgctctcccaggaagtgcccagagtaagcggaatttaaaacgcctctgaagagactaaatatagaactcccccatgcagtgttctatttatctgacttaaaattatgaatattttgaatacatgcaaatcttcccattaatgacaggtgatgattaatttcctattttgtatatattataatcgatgtcattgtatgttttctttaaagttgttttgaaaaaattttattttactatgtcattttacccattttaataacttggtattttaaataaagaattttcattgttgtta

SEQ ID NO: 370436 - DNA, 3170 bp, Homo sapiens
cggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370437 - DNA, 2688 bp, Homo sapiens
ttggcaggacactagtgcttggcaggacactagtgcttggcaggacactagtgcttggcaggacactagtgcttggcaggacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370438 - DNA, 2474 bp, Homo sapiens
tggaggtgacttagaggatccgatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370439 - DNA, 4155 bp, Homo sapiens
cggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370440 - DNA, 3179 bp, Homo sapiens
cggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtaggctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370441 - DNA, 2947 bp, Homo sapiens
cggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatgccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcgaaagcaactttcgatgcatgttcttcaacagtcacattctatgaggaaaacattaagagccacgaacttgttgtttaatctcagagttacagacatattaagttcaaaataaaaggtaaaaaaaacaaaaaacaaacaaacaaaaaacccctcaaacccaacaaaacccaaaaacaaacaaacatattcttgacttccatccccaattttaaaacaacagtttttctacaactcaatgctcgccggcagcacgggaagtggtatgtcggacgcacatacgcacacgcatgctcacacgcacacatattggatatacatacgcaggtgtatgtccatcgaatatatagaacgcatgtaatggcaatgagatgcagtcactctgaggaaggttggtttttctaaatatcctactaaacttgagaaaaaaagtcttgaacccagtttgtgcatagttcatgatcctctataaaaccagcttttgtggatctgcagtcttgcaggacttttttttttttttttgtattttttttgttttat

SEQ ID NO: 370442 - DNA, 3619 bp, Homo sapiens
cggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttgctcttgcccaggctggagtgcagttccatgatctcggctcactgcctcagcctcccaagtagctgggattacaggtgcatacaaccaggcctggctgatcttcgtatttttagtagagatggggtttcaccatgatggtcaggctggtcaagatctcctgacctcaagtgatctgcccgcctcggcctcccaaagtgctgggattacagacatgaaccacaacacctgccgagcccaggtgttttgaatccagcacgggcaatggcaagaccctgtcccaacaaacaaaaaaacactggtgcctgaggcccaccccgagagattctgattgagttgatttggatttgaattatctttaaaattttggatgtgaattttttttttttttcttggaatggagtttcactcttgttccccaggctggagtgcaacgggacgatcttggctcaccgcaacctccgcctactgggttcaagccattctcctgcctcagcttcccaagtagctgggattacaggcatgtgctaccatgcccagctaattttgtatttttagtagagacagggtttctccatgttgctcaggctggtcttgaactcctgacctcaggtgatccgcccgcctcggactcccaaagtgctgggattacaggcatgagccaccatgcctggccggatgtgaattatcttaaaaattttcaggtaattctaatgggccaaggttgagaacccctgctctgggcccatccgagcaccaggctgtcacaaacgcatgcatgcactcacgcccgtgggcttggggggcttcggaaatgtgcttctgcttttttgagatggggtctttctgttgcccatcccggagcacagtggcacgatcacagctcactgcagcctcgacctcctgggctcaggtgatcctcccgcctcagcctcctgagtgtctgcttctggttttcatgatgacctggggcccaggcatactacacttgtgctgttcaggggccagtcctgcaccaggagcccatcagccacagctccgccgagaagcactgatatgcagagctaagcagctttgtttccacgtggatcctgcgtaggttttcttggtccatccgtagacaccgcactcctgcagaggatcttctcgggatgccccactgtctctgttttccctcttcactgaacactcagtcggggctcgccatgatgcctctgtgtctgctggcttctcccccattggaacagccttcttggcacgccacactgctagctgctgggcactgtgctttctgcctttaccgttctgccgtgatgttgccaaaatagcagcaacaacaacaacaacaaaggctgggcacctggctcatgcctgtattcccagcagttcgagatcagcctgggcaacatggtgagaccctatctctacaaaaataaaaaatgaaatgagctgggtggggtggcgcatgcatgcctgtggtcccagctacttgggaggctgaggtcggaagatcgctggagcttaaccttgaggtcaaggttgcagtgagccgagattacatcactgcactccagcgtgggagacagagaccctgtattaacaaacaaaaacacaaaccacaaagggcaggtctgaaactgccatttaaaaaaaaatttaataaacttaaaaaaatatatatccacagatgcaggtgaagaacctgttgtcttcctcaagcctctttttcacccatgggtggaaatggtgccctggacacccaggcccacgaggtctttgcgtggggtccctacacagggctttagcttacactgtgctgccctcctgtcccccgagttcccagtctgtcaaaatccaacctggtctcccaggcccagggcaaatgccacctcctccatgaagcctgccacatcctttgcacacccttgggcgctgaccttgttctcccagcgcacaggcacgggtagtttgcccctgtagtagtaactcaggcacaaaacgaactcttgctgaggctcggccgcgcagagctgagggttgccgcttccaggttcaagtgcattttgagtttcattcccagcttccttctttttctggtctttaatttcttctccggattaggtcccactcaatgctttccttctcaatttccaaaagagtatggtcagagccagcagcacaccaccttccccatgggtgggggggggccagcctgtggcgggggtgcgggtcccatcttttcgaaggaattgacccacagtgggcgggtccacctttgaccttgccccagggagcgcagacagaaaaaagatccttgcttagtttgaggggccgctggggtgctcggtttgtcttcagaggcctgtctgtaacaccaatgccaacccggtggcactgactggtcaccctgaaggccacggccagtgtcctaggaagggactcaatttctagctgtgccacctgagattctggggttaggctggttgtgcttctgaagttccactgtgctcaaagtgcttggtgaaagttagcgaaggtgattttacaaaaatagatgcataaaatgtctaggaaacacaaaaaatcctcattactcttctctccaaatattttttaagccccaactggaccctaggcaaaagtgagtggcactcctctgccaggactccaggcaagccccggcatcttcttgctgccgtcccagacaacagaagttaccagatgaacagacttggatgggccacgggggtggagagctggaaagcttggctgtgcctctcgatgatgattaagatttcaatatttacagcaaaaccacaaagcaaatgatagaataaagcaaaacaatggaaaatctgagttcactcgtgagagaggtacgtatgtgagctctgaggaaattacagagggaacgcatgcagcgggacagctctcccaatcgcagcgtgcaaagtagacatccatagtgtcttttgaaaaatgaaaaacacattactttgaacagccaagaaaaaaattgcaatttattaagattcaataaagcgttgtactttcga

SEQ ID NO: 370443 - DNA, 577 bp, Homo sapiens
ccagggtgggagggtgcttcgggccaatcttgaagcattggcttccagctgttgaggtcctgggggtactgagatggtacttgtttcctaacaaaacattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370444 - DNA, 717 bp, Homo sapiens
ccagggtgggagggtgcttcgggccaatcttgaagcattggcttccagctgttgaggtcctgggggtactgagatggtacttgtttcctaacaaaacattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgcctagtaccgaaggcacttgctctgtggccctggctgtaagaatgatcatttctgagtcagacctagggaaccagcccctgagaatgtgacttgacctagtttatccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370445 - DNA, 2330 bp, Homo sapiens
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370446 - DNA, 2859 bp, Homo sapiens
ggttgttggctgttctcttgccaccactctattaactcataactgctgttctcacgagaggctactggcagagaccaggcaggagctcctggagccaaggtcattgcttttatttttatttatttatttattgagatggaatgttcctttctcgcccaggctggagtgcagtggcatgacctcactgcatcctctgcctcacgggttcaagcaattctcccacctcagcctcctgagtagcagggattacaggcgtatgccaccacactaggctaattttttttacagacacgatttcgccacgttggccaggctggtcttgaactcctgacctcaagtgatccacccacctcagcctcccaaagtgttgggattacaggcgtgagccactgcacctggccaggctcatcactttttgcgcctattgcctcgaagccagtctctgatgggacattagggcaggggcccttcagcctagtctgggacatgggccgctcactcagcagtatgacaagcatcacctggagaacgggccagtctcaggaggtcgttcatgccccactggcagtgcactgtgcagccatagtgtaaacaagaggcttaacctgaactggtctgagatcttggggaccccctaccctgtctccagcagcctgtccctttagctgtttgcctactggcaccccatcctgagaaggcatagatacccggcccaccctgccctggaattacaaaagtcttagactgtgcctgagtgcccggcctccttgggagaccctcctaggcagcctaagcaccagacccgggagctgggtgctctggtcctgcctgcctgcctctcactggaccctctccttccaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370447 - DNA, 2396 bp, Homo sapiens
  misc_feature (21)..(21): n is a, c, g, or t
gatagctgttccagaggatcnccagtccgttcgacatgagcagtatgacaagcatcacctggagaacgggccagtctcaggaggtcgttcatgccccactggcagtgcactgtgcagccatagtgtaaacaagaggcttaacctgaactggtctgagatcttggggaccccctaccctgtctccagcagcctgtccctttagctgtttgcctactggcaccccatcctgagaaggcatagatacccggcccaccctgccctggaattacaaaagtcttagactgtgcctgagtgcccggcctccttgggagaccctcctaggcagcctaagcaccagacccgggagctgggtgctctggtcctgcctgcctgcctctcactggaccctctccttccaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370448 - DNA, 2698 bp, Homo sapiens
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370449 - DNA, 2462 bp, Homo sapiens
cggagtgactctacaggatcttatgtcatcccccttcgtgtgtgttctgaaagtagcccagcggggcccttcctcgctctttttccttggcccagggcaagctgtgagtggcaggcaccagaccagccttgtgcttgctggcagcgctacacgtggccgctcttcccactgagcaaaggcacagctgacggcaaggcaggatgcgcaccctgagctgggtttgcgggagacttccggtctccttttctggtgagcctaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgaggggatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370450 - DNA, 2391 bp, Homo sapiens
cggagtgactctacaggatcttatgtcatcccccttcgtgtgtgttctgaaagtagcccagcggggcccttcctcgctctttttccttggcccagggcaagctgtgagtggcaggcaccagaccagccttgtgcttgctggcagcgctacacgtggccgctcttcccactgagcaaaggcacagctgacggcaaggcaggatgcgcaccctgagctgggtttgcgggagacttccggtctccttttctggtgagcctaggcccttgggactgaaagaatccaagatctggatctcctctatagcgcccagaaccacagccaccgtcctgaagcacacggccttcacacgtttctacacgaagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370451 - DNA, 1925 bp, Homo sapiens
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370452 - DNA, 2297 bp, Homo sapiens
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370453 - DNA, 2712 bp, Homo sapiens
gtatcagccagtgcatcaggacctggggtcgtcactcccaaggggccattaccctgttcagtctccgtggccactctgggggagggaggtaaacctttacaggtaaggcccagagtgaggcccagagacagagtcatttgtgagcacgccaggctgatgagcggcagggggaaaattcaaatctggggagggtctgaccccaaagtccaacatctctggagcctcctgcccatgtcaggtgtttggattaatgggatatcccagaaatagtgtgtgcagcctcccagggacaacttctgctgtcagccacccagaccagtcagccgcggagagcagcagcctgcagatgggacaccagtgctgagtgggacaggtgctggcttggccttgggatgtcacatgcataccctcccagtggacgtgaggattccaggggctcatgggatctgcctgctgcacccacaggtgtggcaggcgtgcttgtgggacacccgtttgacacggtcaaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgaggggatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 370454 - DNA, 2322 bp, Homo sapiens
  misc_feature (2223)..(2223): n is a, c, g, or t
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggaccgtcatctcactgttgatcagtatcaagggcactcgctaagttggtgcatcacggggctgagatatgattgagcgcnattgcgagacagatgtgatgggtcatgatacacaggcgttctataggggaactgtgtctcagtgttagtaaaacatcggagctttgacacagcacactg

SEQ ID NO: 370455 - DNA, 1520 bp, Homo sapiens
ggcgcgcggcccgaattgagggatgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagactcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagcctccagcctgtgacgctcacccggcctccttcccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagaccacaggacgggttgatccggccgcgaatttagtagtagtagtagacc

SEQ ID NO: 370456 - DNA, 329 bp, Homo sapiens
ttctcccatctttaaaactccagtttaacttccttgaagatcactgtgagctccacttccctcagtagcttctgctttccctaactcccattccacttctctttggtaccacatggaaggcttatagttatttatgcatctttagttacttaattatgttcatcctaagtatacagtaagcccccttggaaggagcaactatgtgttatacttctcttgaattcagtgaatatatgtttaaaaggggttttaagaaattgttattaaaactgctcaatgattagtgcattattttagcatttgcaaaaataggggattcttttgaccca

SEQ ID NO: 370457 - DNA, 1082 bp, Homo sapiens
cttagctatgagctcacatttgccaatgtagtgttccagacagttttatcatccacattgctgacctggaagatgcatcattgtctatgatatctgcaatggaaatgatcactaggcaatttcagccttgcaaatctaactgtggcgtgtggaaagaagaggaaccagaaaagaatgtttgtgaagttctggcttgaatctcgtgccgggagtgtgaagaaggtccttgcttccccttcaccttctgccatgattctaagtttcctgacgcctcccagccgtgcttcctgttaagcctgtgaaactcctttggaatgagtacacatccaggagtgaagaagacaagctcaactgccattctctgagcagttcaaggcatactgagttgcgggagttgtgtggtggtccactctgactgcaagcacccctttcttgaaccgaacagagtcaagtggaatcaaaggacattacctgttgattcttgggcaaggcccagaatttggtggacatacttaaagaagaaaggaatcttcagctaaagtgtctacgatcaattcagatttggagggcatggatcttctgacagtaggggccattctaggattttttggttgaagagatgaacttcaacttggttccagatgggtggtccagctattctgctgacaacatttttcagggcaaggcttttgctactggaatgatttaaggaagatccctcagtgtttcagagtaaagatatttctaaagaagtacctgtgtcattgcccatcttgaagattgacttttatggattgctcaaatactgatatcagctcaatgtcaatatatactcctacatataaaatccatcttctaatcataatcactaggtaagatgctagtgcaagttgaagttcttaaaggagatgacctgaacagccttcttagtgtaccagggagaccagattgagtttaaactatgtttaccctgcactcagacacgcctaggtgtgtctgggagattagtagatggtgttcaacaaggatctatttaaacaagggagacattaatttggattcctttggttgtaaatttccaa

SEQ ID NO: 370458 - DNA, 677 bp, Homo sapiens
cttagctatgagctcacatttgccaatgtagtgttccagacagttttatcatccacattgctgacctggaagatgcatcattgtctatgatatctgcaatggaaatgatcactaggcaatttcagccttgcaaatctaactatgaacagtgacggacaggctgagagcggagagactttcccttggacccttgcctcagtaacttttaatacatgtaagacggatcatctgactttggactttctgaagcaataacatcggaaagttaatcagagttggcgttctgggaattcaagggcagagataagtgtttcctccagatacttcactgtatttcagcaaatgacctgaggaaagaagtcaaaacttcatcacgaaatagaagactgttcattttcaatatttcttccttggcctctatgtggcactcccttgctgtctgtcctgttgacttctatggcttccacccaagggaggacagcattatagtgggtgaatccagcacaccccaaactgcccctgctcccctctcccccgggcatgtgggccctcgaaggcaggcttctccaaaccagcagcatgtgaaccctgccagaagtgaggaagagctctaggagagcagccagcagcatctgttttgcatacaaagggcagcaacaatcaaatctcttctagaa

SEQ ID NO: 370459 - DNA, 606 bp, Homo sapiens
acgcctcccagccgtgcttcctgttaagcctgtgaaactgtgagtcaatcaaacccttttcttcataaattacccagtttcaggtagctctttatagcagtgtgaaaatggactaatacagaaaattggtaccagagaggtggggcattcctataaagatacctgaagatgtagaagcaattttggaatttgggtaatgggcagaggttacaacaatttggagggctcagaagataggaagatgaggggaagtttggaacttcctagagacttgttcaatggttttgaccaaaatactgatagtgatgaatagtgaagtccaggctgaggtggtctcagatggaaatgaggaacttactgggaattggagcaaaggtcactcttgctatgctttagcaaagagactggtggcatggtgcccctgctctagggatctgtggaaagaaatttctaggcagtaaagtgttcaagatgtgatctggctgcttctaacagtgtatagtcatatgtattcataaagagatgttctgaaattggaacttacattaaaaagggaagctgaatataaaagtttggaaactttgcagcctgaccatgtggtacaaa

SEQ ID NO: 370460 - DNA, 1415 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370461 - DNA, 1461 bp, Homo sapiens
ctagaatgggatcacacccttgcctcatccccagcgcttcctgccatccaccccttgaaacagattttctttccctgctccccactcatttctgcctggctgtgttcaccaaggagagattctcaccccctcccccatctccctatccacgtttctagaaattcctaaggtcttaaaagttttccttttttttaccccctttccttttttttggaggcacggtcttgctgtgtctctcaggctggagtgcagtggcgcaatcatggctcactgcagcctcaacttccctgggctcaagcgatcctcccacctcaacctcctgagagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370462 - DNA, 1357 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacgtaagtcgtgcctctgtgtccctgcctgtctgtccgtcctctgcgccggtttcgggctccagcagggactgggtacttctgagtaaaatgcctcctccctgcttagtttctggcagctttttaacgcgctgacgttgttcaacctggcccaggaccctcagtgcaaggagtggcagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370463 - DNA, 1219 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcctatttgcctaagaagaatggattgtacctgagcctggttttggggaacgtcaacgtcacgctcctgagcaagcaggctaagtttgcctacaaggacgagtatgagaagttcaagcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370464 - DNA, 1513 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggtgagtggctgggccccggcaggggcaggagctgggacaaggaggggatacacggcatccccaagggtccccacactgccctccactttttaccttaggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370465 - DNA, 1472 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtgggtgagtcgggagtggccctggcatctggacattcccctttcctcccatcccgggtctgagtggtagcgtcccctctgtccctggccgtcctgtgccctgaccttcctccccgcagagggcttccagtcctggatgtggcggggcctcaccttcctgctgccttttcttttctttggacacgtaagtcgtgcctctgtgtccctgcctgtctgtccgtcctctgcgccggtttcgggctccagcagggactgggtacttctgagtaaaatgcctcctccctgcttagtttctggcagctttttaacgcgctgacgttgttcaacctggcccaggaccctcagtgcaaggagtggcagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370466 - DNA, 1127 bp, Homo sapiens
ccttggctcagctgccctcccggggtgggggcacacatgggccccaccagcaccccacccgtctcaccggcctgcgccccccaggtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggtgagtggctgggccccggcaggggcaggagctgggacaaggaggggatacacggcatccccaagggtccccacactgccctccactttttaccttaggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370467 - DNA, 1312 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370468 - DNA, 1592 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggggaaaaaaaaaaaaaaaaaaaaacaaaaaaaaaaaaaagggggggccgtctaaaaatttcccttcagggggcccatttaaagggataccaagaatactggtaaccgaacggggtgcccccaaaataaggaaggacagcaaataaatacagcaaagcactaggccacacagataaacacaggtgcgagacggcggaaacaagctgcgcaaatggaggaacactagggaaaaagaaacataaaaatcacaggaggagagaaacaataagtgggaacaacatacc

SEQ ID NO: 370469 - DNA, 1250 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370470 - DNA, 1226 bp, Homo sapiens
tgctggaatgggagaagactatccttggagattccatcacaaacatcatggatccgctctactgatcttctccgaggcccaccgaagggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370471 - DNA, 1049 bp, Homo sapiens
tgccctgactgtttctggccttacccgcagatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370472 - DNA, 1252 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatgggtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370473 - DNA, 1247 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370474 - DNA, 1185 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggttctggcagctttttaacgcgctgacgttgttcaacctggcccaggaccctcagtgcaaggagtggcagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370475 - DNA, 892 bp, Homo sapiens
tgctggaatgggagaagactatccttggagattccatcacaaacatcatggatccgctctactgatcttctccgaggcccaccgaagggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggagggcttccagtcctggatgtggcggggcctcaccttcctgctgccttttcttttctttggacacttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagagggg

SEQ ID NO: 370476 - DNA, 1512 bp, Homo sapiens
agcccggaagcggacgggggcggtggcggaggagcctcgggtgggccggggttgctgcgccgtcctccactactggctactggcgctgcagccatgcagcccccgcccccgggcccgctgggcgactgcctgcgggactgggaggatctacagcaggacttccagaacatccaggagacccatcggctctaccgcctgaagctggaggagctgaccaaacttcagaacaattgcaccagctccatcacgcggcagaagaagcggctccaggagctggccctcgccctgaagaaatgcaaaccctccctcccagcagaggccgagggggccgcacaggagctggagaaccagatgaaagagcgccaaggcctcttctttgacatggaggcctatttgcctaagaagaatggattgtacctgagcctggttctggggaacgtcaacgtcacgctcctgagcaagcaggctaagtttgcctacaaggacgagtatgagaagttcaagctctacctcaccatcatcctcatcctcatctccttcacttgccgcttcctgctcaactccagggtgacagatgctgccttcaacttcctgctggtctggtactactgcaccctgaccatccgggagagcatcctcatcaacaacggctcccggtgggcagggcgggccctgagggaggggagcatggaatggggtgccaggaccctccgggaagcaggaacaggcgctgggggtgatggtggctctctgctccaggatcaaaggctggtgggtgttccatcactacgtgtccaccttcctgtcgggagtcatgctgacgtggcccgacggtctcatgtaccagaaattccggaaccaattcctctccttttccatgtaccagagcttcgtgcagtttctccagtactactaccagagcggctgcctctaccgcctgcgggcgctgggcgagcggcacaccatggacctcactgtggttctggcagctttttaacgcgctgacgttgttcaacctggcccaggaccctcagtgcaaggagtggcaggtgcttatgtgcggctttcccttcctcctccttttcctcggcaatttcttcaccaccctgagggttgtgcaccacaagtttcacagtcagcggcacgggagcaagaaggattgaggctgggccttcccctgccggcccagaggggcttctgtcctgtgtgttgtgggaggggatgggaggcgcccctcgagtgtgcgtgtatcagggggtctcttctattctcccttgggttttatgggcgctgtgggccctgaaggaagacctgggcccagtgccctcaataaagagaggcccagaggggaaaaaaacacaaaaatcacataatactatcctaccacacatattcacatcatcatttcaacactacaccactaatacaacaggctctccccctacataatattatcccttgagctctccacatttcttcccaacccacatatatttacacaacaaattcctt

SEQ ID NO: 370477 - DNA, 1031 bp, Homo sapiens
taaggtcaagagagcagcttatggaaatgtcaaacccacattataaaacccaggaggcaccaaggcctctcgtgggagaccagcagggaggaaagatctccaggctcataggccagggctgtggtcttcacattccccgacccctttggtgatctgaggaaagttcatagcccaatcccaggacagtatgctcatattatttgcatacagtttgagggggttcacacatacacacacacaccccaaggccatttgtggacccagattagaagccctgaggatcctaggtccagaagaaagggccttgtcggaggccacacaggccaccaggagccaggcccctgaagatccttggcccaggagaaagggccttgccagaggccacacaggccaccaggagtgaggcccccagaggggtcagcagggcctaccctacaccaccccacccttcaacacgcccaggcgtgcacgctgcaggccagacaaccctccagctggtgtccccagcacccaacccaagtttttctcctgctcaggcaccagcagtcttcctggttgcactctaagctccagatcacaaagtcgagtccttttgttgtgcactgttcactcccccgtagaccaccctgttcctctggggagcttgtctataactagacccactcctggtagtccagcattaagaaaagtcagcacctctgctcacccatatccatcctgggtagtgctggggacacaggaaagacagccctagccctgtccttccagggcttacagtccagggagagacaagaagtccctggccagtaacaactgagaggggtggcctgggactgggcagcccagaggggccatgtaacccagcctgggtgtgggacatcagggaagacttcccgaaaaaggggacactcaggctgagaccaaggagggatgagtaggcggcagcagcaggagactgcagggaccgagggaggtgcttgctggctggttctggacctaggggacgaaggagggggcctggtcaagggagg

SEQ ID NO: 370478 - DNA, 2043 bp, Homo sapiens
gccctgcccagggcgagggcagagcgggcccgcccaggtgcgcccgggggttgggccggagtccggaaggtgcgccgcgccgccccgaacctgtcccctaggcctccccccgcgtgaaagtgaaagtgtcggacccgcggaggtcaaggataggggggcggggccagcgcggagctgggagcgggagccgggcactccaggggccatggatgggctcggccgccgccttcgagccagcctgagactgaagcgcggccatgggggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370479 - DNA, 2054 bp, Homo sapiens
  misc_feature (1)..(1): n is a, c, g, or t
  misc_feature (5)..(6): n is a, c, g, or t
ngccnngcctgggtcccgtcacatccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatggaaggacaagtggtaggccgggtgttcaggctcttccaacgccgactgcttcaactccgagcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370480 - DNA, 1002 bp, Homo sapiens
  misc_feature (892)..(892): n is a, c, g, or t
  misc_feature (894)..(894): n is a, c, g, or t
  misc_feature (899)..(899): n is a, c, g, or t
  misc_feature (901)..(901): n is a, c, g, or t
  misc_feature (904)..(904): n is a, c, g, or t
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggtatctcagcattggcaaggcggccttgaggtgtggaggtcacccggattctcacagactccactccaggaatggatcaatgagattatactaaatgggctctggcttgatttcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggtgnangtggngnaanagacctcgatttccactgggggacactacaccgggacatagcagggctccaaaggaacttcccggtcctggaaaaatgcgctctcaaaagttttccca

SEQ ID NO: 370481 - DNA, 1204 bp, Homo sapiens
gccctgcccagggcgagggcagagcgggcccgcccaggtgcgcccgggggttgggccggagtccggaaggtgcgccgcgccgccccgaacctgtcccctaggcctccccccgcgtgaaagtgaaagtgtcggacccgcggaggtcaaggataggggggcggggccagcgcggagctgggagcgggagccgggcactccaggggccatggatgggctcggccgccgccttcgagccagcctgagactgaagcgcggccatggggatgtggggaccgaccccaaggcaccacattcacgggggaagctttacacaggaacccagcaacagggcccaggagccacctcttttgccccaattttgctggggggagcagcaactttccttgtgaaattaccctttccttgtaggattccgtcttcaaaacacggaaagcgttcaagaagggactgcatttaccgaaggccctagttaaattcagcgcttaaccagagttttccgcaaaggcggggaggaacccttgcctaccggcgaggctccagggcagggaagggagggcagggacgcaggacatgcttcaaaagtctatccccacttgtatctgcttccccaagaatggggacattgagttgggccattcacctcacccgaggtattcccaagggagcaccctttctaccattcggtatactgaccccaaattgttggcgattggggcagcaagcaacacgcattgggaattaactgccagggcgccttctttgccttgccaggggcccgtgggaccttcaggccatttccccaaaaagggtggtaccttggcattccaatccatcggttgcaatcagagctggcgtacagggcttgttcactccgagagattccgttgggaatctgacaacggtggggcatagcaacaagaccagattcgaagagatctgtcccaatgtgggcatggtgtcatcgcataccccaccgagtatcagatgcgccaaggcgcgcttccacagaagcaggggacaggccatttatccccttgggctacacattaaggaaacgaacttggtacgcatctctctccaaaaggagacggtttcatctccccccgagagacttatcgagccagctcagggcagttatcaaatttcacacatctgagaagacggggcccctacgtggaacatccacgaggtgtaaggagacacg

SEQ ID NO: 370482 - DNA, 554 bp, Homo sapiens
ggctcaccgcaagctccgcctcccgggttcacgccattctcctgcctcagcctctggagtagctgggactacaggcgcccgccaccacacccggctgattttttgcgtttttagtagagacagggtttcaccgtgttagccaggatggtctcgatctcctgacctcgtgatccacccgcctcggcctcccaaagtgctgggattacaggcgtgagcaccacgagaggcaggagtttttctaatagaaaattgtacataagatgttgcaagcatgaaaaaaataaaaagatgttggtctctgttctagagagcagggagttgaaggggaattgtagagagaggaatgcaatctcaagaatatcagtctaggcttggaaaaaaattggttctcttattagcagcatagtatgacctcgggcagcttctttgggtctgtttcctcatcttcaacacttatgtgaacaatgtactaaatgctccatgtagaagcaatttctgcagtcaatgttttattaagggagtgactggctgtgatttctccatcttgtatttcc

SEQ ID NO: 370483 - DNA, 2225 bp, Homo sapiens
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggtatctcagcattggcaaggcggccttgaggtgtggaggtcacccggattctcacagactccactccaggaatggatcaatgagattatactaaatgggctctggcttgatttcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370484 - DNA, 2196 bp, Homo sapiens
gccctgcccagggcgagggcagagcgggcccgcccaggtgcgcccgggggttgggccggagtccggaaggtgcgccgcgccgccccgaacctgtcccctaggcctccccccgcgtgaaagtgaaagtgtcggacccgcggaggtcaaggataggggggcggggccagcgcggagctgggagcgggagccgggcactccaggggccatggatgggctcggccgccgccttcgagccagcctgagactgaagcgcggccatggggggggttagtgccggccggggagagcgcggggggacggcgtgggcaccggggagccggggctagggctggcggctggggcccggtggagggcggcacggggcgtcgagatccgggagcagttggaaggggactcaggaggctgcgcgggggcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370485 - DNA, 1806 bp, Homo sapiens
ctttgcccaactttgctggggggcaaagagtgctcctgggccctttctggttcctttaaagcttcccctgaatgtcctggggcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370486 - DNA, 1049 bp, Homo sapiens
ccagaggggaatggtgagaaaggagaatgctagataggaaatgagaactgaagatattgattttgttgctacctgggctgaaagatacagccacaggcagaaatcaagacggtaaatcctctgggggtctatgaagaaagaggaccagagaaagccagtctatgtttatttcaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370487 - DNA, 3263 bp, Homo sapiens
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttatttttatatgtgtctttggcttttactatgggtaaaagtattttcctcgtggaaaataaggcaatgaatatgacaatcaagtggactacaagtggaagacctggccatggggatatgtttggagtgatagaatcatggggggcagcagctctacttcttctaaccggaagggtaagagatactggtaaaagcagcagcagcactggacacagggcatctaagtccttggtttggagtcaggtgtgctttccagaatcctgggaggagaggctgctcactgaagggaagcagcttcagtctagagtaatttgaggataggaatttcagtcaacagcagcctgtgaagaacactacatggcttccatacgtaggtctgtttccccatcactttcagtttgcactagtcctttaccttcagtcttggacatcctacctccaactgatctttattttgagcagcacagtccaattctttaactaaaggtgaagggatcgctgcactgacgttcttcccctttgagaaaagaatcgtaattttaagagtctgaaggagtttagtggtcacctagtctctcctcccttgatacctctactgatactttctactcaagcattgggaagcttttttagaagaatcttatcttcactatacaaagaacacaaaagtttctggagggtggaaccggggcatactgaagttcaagccaatgtaatttgcttttgggagtgcagagacctactgcaggtggcagatgtcccactgtccacacaccgtgcttagctacactactattcttcacagcttctaggaattacatttttttttggtagtttatggcagtggtgcctaaatatagttgtacctccaaaggtttcagaacaggaactggaatcctgagaatcttgtgaaaatatcctcttatgcctcatcacaaatacaccaaatcatctctagtgataggacctggaaatctgtactttcttaaaaggttcttcaggtaaggtttgctgaggtttattacaaatgtacccttgatttgatgctaatgctgtatttagggctgaaggaagcacacactaaatatctgagtgcttttcagattccatctatgctgaaaaagaatctaggagaataaacacatttcaattagcccttaaca

SEQ ID NO: 370488 - DNA, 929 bp, Homo sapiens
gccctgcccagggcgagggcagagcgggcccgcccaggtgcgcccgggggttgggccggagtccggaaggtgcgccgcgccgccccgaacctgtcccctaggcctccccccgcgtgaaagtgaaagtgtcggacccgcggaggtcaaggataggggggcggggccagcgcggagctgggagcgggagccgggcactccaggggccatggatgggctcggccgccgccttcgagccagcctgagactgaagcgcggccatggggggggttagtgccggccggggagagcgcggggggacggcgtgggcaccggggagccggggctagggctggcggctggggcccggtggagggcggcacggggcgtcgagatccgggagcagttggaaggggactcaggaggctgcgcgggggcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaaggtaaggactgaaggaggggcagggccagccagaggactggggtgtttggaaggtggtaggggtgggggttccacctccttctccctaccctaccggggcttgagcctggagctgccctgagctctgagctcactgctctccatttccttcttagcacagccccagttctctgttatcacccacagaatctaggtctaacttctttgtgagggactgacctaggcttcctagcagggaaactaggctagacattttgccttttaggggacctgataggtcttccaaatcccattttcagtcacccttctctgcagagaagcttaccttctgccagaac

SEQ ID NO: 370489 - DNA, 382 bp, Homo sapiens
gcccttggggaggctgcagcactgaaggagcctctctgtccctccccagcctgccggccctggccctcgccttcccaaagtgtactgcatcatcagctgcatcggctgcttcggcttgttctccaaggtagggataggattcctcagggcctgcccatattccaggctgtctctggctgccaaccctgcctgtgcaactaagctcttagtggagctcttctcccatagccagagtcagcattaaagcacacttgggaaaactgaggcaaaggggcatgcacttgacttaagggaaaagtggaaattgaatctaggggactggacctcttgcagagacagctactgttcccactctagccaagtaagaaagtagttgaagtag

SEQ ID NO: 370490 - DNA, 194 bp, Homo sapiens
ccagtctatgtttatttcaggtcctgctggtcaatctttgtgaaggaaccttcttaatgtcggtaagtgtctgggttcagatcccctgcaggcctatcaacaactctaccactctagtttcatccatgttccacttatttaaacaaacatttaagttctttgttgagtgagaatctgtgctaaaaagaccacat

SEQ ID NO: 370491 - DNA, 519 bp, Homo sapiens
gtttttctaatagaaaattgtacataagatgttgcaagcatgaaaaaaataaaaagatgttggtctctgttctagagagcagggagttgaaggggaattgtagagagaggaatgcaatctcaagaatatcagtctaggcttggaaaaaaattggttctcttattagcagcatagtatgacctcgggcagcttctttgggtctgtttcctcatcttcaaaatggagattgtatctgcctcacgggactgttgcttgagatcaaacgtgtaaagcacttatgtgaacaatgtactaaatgctccatgtagaagcaatttctgcagtcaatgttttattaagggagtgactggctgtgatttctccatcttgtatttcccttctaccttagctctttctcctactcccttcctacaaacacccacaccctttcctcaggaatggaactgagatctccagaggggaatggtgagaaaggagaatgctagataggaaatgagaactgaagatattgattttgtt

SEQ ID NO: 370492 - DNA, 2109 bp, Homo sapiens
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 370493 - DNA, 3317 bp, Homo sapiens
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttatttttatatgtgtctttggcttttactatgggtaaaagtattttcctcgtggaaaataaggcaatgaatatgacaatcaagtggactacaagtggaagacctggccatggggatatgtttggagtgatagaatcatggggggcagcagctctacttcttctaaccggaagggtaagagatactggtaaaagcagcagcagcactggacacagggcatctaagtccttggtttggagtcaggtgtgctttccagaatcctgggaggagaggctgctcactgaagggaagcagcttcagtctagagtaatttgaggataggaatttcagtcaacagcagcctgtgaagaacactacatggcttccatacgtaggtctgtttccccatcactttcagtttgcactagtcctttaccttcagtcttggacatcctacctccaactgatctttattttgagcagcacagtccaattctttaactaaaggtgaagggatcgctgcactgacgttcttcccctttgagaaaagaatcgtaattttaagagtctgaaggagtttagtggtcacctagtctctcctcccttgatacctctactgatactttctactcaagcattgggaagcttttttagaagaatcttatcttcaaaaattctaccttttttaatgtgtgtatttgtggccctcagaagttcctaaattctatacaaagaacacaaaagtttctggagggtggaaccggggcatactgaagttcaagccaatgtaatttgcttttgggagtgcagagacctactgcaggtggcagatgtcccactgtccacacaccgtgcttagctacactactattcttcacagcttctaggaattacatttttttttggtagtttatggcagtggtgcctaaatatagttgtacctccaaaggtttcagaacaggaactggaatcctgagaatcttgtgaaaatatcctcttatgcctcatcacaaatacaccaaatcatctctagtgataggacctggaaatctgtactttcttaaaaggttcttcaggtaaggtttgctgaggtttattacaaatgtacccttgatttgatgctaatgctgtatttagggctgaaggaagcacacactaaatatctgagtgcttttcagattccatctatgctgaaaaagaatctaggagaataaacacatttcaattagcccttaaca

SEQ ID NO: 370494 - DNA, 3263 bp, Homo sapiens
ggtttttaagagctggtcatgccctctctggggctagtgtggtcacagtcacatgccctttgagcctgttcttattcacttagtatgaactaaactctcaggccatattgttccaggactgccagaagcacccgacaggttaggcagtctctgtggtaccctggggccttggcctccatgtggcctctccagcacatttccgtggcttctgtgtcagtggtttctttcctctgcttggctccccatggtttcaagtctaccagggcaggtgtggaaactgcccatttggccctgatcctgagtgactggtggttctggccagtatccaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttatttttatatgtgtctttggcttttactatgggtaaaagtattttcctcgtggaaaataaggcaatgaatatgacaatcaagtggactacaagtggaagacctggccatggggatatgtttggagtgatagaatcatggggggcagcagctctacttcttctaaccggaagggtaagagatactggtaaaagcagcagcagcactggacacagggcatctaagtccttggtttggagtcaggtgtgctttccagaatcctgggaggagaggctgctcactgaagggaagcagcttcagtctagagtaatttgaggataggaatttcagtcaacagcagcctgtgaagaacactacatggcttccatacgtaggtctgtttccccatcactttcagtttgcactagtcctttaccttcagtcttggacatcctacctccaactgatctttattttgagcagcacagtccaattctttaactaaaggtgaagggatcgctgcactgacgttcttcccctttgagctcccttgatacctctactgatactttctactcaagcattgggaagcttttttagaagaatcttatcttcaaaaattctaccttttttaatgtgtgtatttgtggccctcagaagttcctaaattctatacaaagaacacaaaagtttctggagggtggaaccggggcatactgaagttcaagccaatgtaatttgcttttgggagtgcagagacctactgcaggtggcagatgtcccactgtccacacaccgtgcttagctacactactattcttcacagcttctaggaattacatttttttttggtagtttatggcagtggtgcctaaatatagttgtacctccaaaggtttcagaacaggaactggaatcctgagaatcttgtgaaaatatcctcttatgcctcatcacaaatacaccaaatcatctctagtgataggacctggaaatctgtactttcttaaaaggttcttcaggtaaggtttgctgaggtttattacaaatgtacccttgatttgatgctaatgctgtatttagggctgaaggaagcacacactaaatatctgagtgcttttcagattccatctatgctgaaaaagaatctaggagaataaacacatttcaattagcccttaaca

SEQ ID NO: 370495 - DNA, 398 bp, Homo sapiens
atggacagaatagagttcaaaaatggacccatgcatatatggacaattgatttttgacaaaggcacaatgagctgtgtgtggtggtgtgtgcctgtagtcccacgtgcttgggagactgagatgggaggatcacctgagcctggagaggttgaggctgcactgagctgtgattgcactccagtctgggcaaaagggtgagaccctgtctaaaaagaaaagaaaacaaaacaaaaaggcaccaaagcaaagaggaaaagcatcttttcaacaaatggaataagtatatattcatatgagaaatgaacctcgacttttacatcacatacataattttagtgaaaaatttagattttaaaatggatgatagacctaaacaaaagctaaacctagaaattct

SEQ ID NO: 370496 - DNA, 422 bp, Homo sapiens
gcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatttggttaattttttatttctaattcgcgcccttctaaaaaaaccccttttccctttccgccctcccaacaaacccctgttgcccagtatttatgtggtggcctttaaccacctgagggaaaaaatgag

SEQ ID NO: 370497 - DNA, 891 bp, Homo sapiens
cggaccgcgtgggtcgacccacgcgtccggacccacgcgtccgccaatgttcatatggaactaggtaattcactcttatgataaagagctattaaaatggctttgcttacaccttttaaaagttttcatgctgaaaaagaaatagtgtgatgttggagaaaagagatagaagtcggtggagaagtggtagtgatatacaaagtaatatgtacatttttttggataaaagaagcatatttcctatgaatgaacgacatcaaatatatactactctttaaaaatttgttttcactgaactgtatgattgctatctgcagatgttctagttaagctaaaaagtaaaaacttttttaactagtggcttttatataaaatgtgctcctgaagctacacaattttgaaagagtaacatttcttgctacaaaaactttcaaaggaatttatttaaaaaaatacaatctgtgaagattttagttgtgtgacgactattgctcacaccatcttttcattttatgctattaattgatatgtgggtaaaatgcaagattcttggttaaaagcttaccaaacttaaatttcactcatttatactgtatgtataacgaaaacataacgtctgatgttttcatcatgaatttgtttgtggtacatcaattcctatattgtctgatatttttccccttgctgttttcccttgtgttaacctgcaaagaacataggaaacactgtaaatcatattcctcattcactctattttataaagctttcatgtgtcactaaatttttcacagattatttcttacaaatttttggaagtgcgattagcctttataggttaagaatttacttttttttttttggcaaaaggtcatgtctcggtaattatttgta

SEQ ID NO: 370498 - DNA, 331 bp, Homo sapiens
tctgtcaactgtctacattcagcagtggaatggaacaggcacctgggattcataatagtaaaagggtcaggccatggggagcagtctgggtttgatggcttctttgccttccatcagtgctccttgccacctaccattggggacatcctccttcatcgtattactgcctcatgatggtctgtgaacccatctcacctaagttaagtaaacactgggcctcaacttaaggtgataccatcatcagagtaatccttaggagaaagtagataaatagaagatgaggcatgttatgtcctgaaagatggtcaactccttgtctaaagaactaggt

SEQ ID NO: 370499 - DNA, 479 bp, Homo sapiens
ctctgttctaacctattagaaatatttctaaaatgtgtcagtagctaggggctgcccctcccttcacaactattgtgcaaggagagggaaagggcatttgttaggcacctctattatctatccactcagttgcacttaaaggctgttctttcagtctctctggctgagctcccaccaggcgagaagccagtaagtgggatcaagccacgtgccccctctgatgatctgccttagctgattgagtagtcctaaatcaaccagaggaaatgacagtctgtcagaacaaaaggcatgtatgttatgagcccgaagtcactgtggaggcctcaaaagacaccaattttgagcagaatattttggattctctctctgtgagacctgtagcaacagagacctgcactggcatttggtgtttccattccagttgtagcactgggatagcctttgacctttctttcaaagtaccttatcacaaaaaa

SEQ ID NO: 370500 - DNA, 338 bp, Homo sapiens
cctggactgcggaccctgctttctaccattgagccacattcccctgggaccctaactacatttgtcagccagctgaatgaagcagatttggaattgtcagtccagctgttttgttggctttgattcgctacaatagaaatgccagcacctgcaatgtcttcctgacattgcaaagcaggacttcctgagggagggtagggaatggggtgtagtcagtccataggctaaaccatcatagactacttaggagttattttgtgagaaccaatatcttgactaaatggaaccaatcttgttaggtttaaataatctttctttgaattatgcttctactttaa

SEQ ID NO: 370501 - DNA, 427 bp, Homo sapiens
ctaaagtcccataactagtgataatttagcatatagcagctgttgtacctttaacttacacaatgtgaaaaaaactagcattccaattgagtctgcttttccacttttgcccattgcgattgggtctgcttttccacttttgcccttccacagggcacatgaaatggaaaaactgcattggcaactttgccggtggtcatatgactgactcttggctggtctcactttgttgctcttggctgaggaagacacattttaaatgttgcatgctatgtgactaagtctcctgagaaaatcaccctaattactgtatggtcaaaacacactgtactgtatttttgatgactgtgacttcattttatactttttaaataatgtgcaagtctcttcaacttgaataaattagattacaaattacaaaaaaagt

SEQ ID NO: 370502 - DNA, 1389 bp, Homo sapiens
ggggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacctgctggctttagaataaaagcaccaactgaactgaaaaaaaaaat

SEQ ID NO: 370503 - DNA, 1254 bp, Homo sapiens
ggggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaaggcaactacacaccaacctgctggctttagaataaaagcaccaactgaactgaaaaaaaaaat

SEQ ID NO: 370504 - DNA, 1302 bp, Homo sapiens
ggggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgctctctttcctgggccctgcccctctccccacatgtatccctcggtctgaattagacattcctgggcacaggctcttgggtgcattgctcagagtcccaggtcctggcctgaccctcaggcccttcacgtgaggtctgtgaggaccaatttgtgggtagttcatcttccctcgattggttaactccttagtttcagaccacagactcaagattggctcttcccagagggcagcagacagtcaccccaaggcaggtgtagggagcccagggaggccaatcagccccctgaagactctggtcccagtcagcctgtggcttgtggcctgtgacctgtgaccttctgccagaattgtcatgcctctgaggccccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaaggcaactacacaccaacctgctggctttagaataaaagcaccaactgaactgaaaaaaaaaat

SEQ ID NO: 370505 - DNA, 1021 bp, Homo sapiens
ggggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaaggtccccttcttcaggaaacgcaagcaccacacctgtccttgcttgcccaacctgctgtgctccaggttcccggacggcaggtaccgctgctccatggacttgaagaacatcaatttttaggcgcttgcctggtctcaggatacccaccatccttttcctgagcacagcctggatttttatttctgccatgaaacccagctcccatgactctcccagtccctacactgactaccctgatctctcttgtctagtacgcacatatgcacacaggcagacatacctcccatcatgacatggtccccaggctggcctgaggatgtcacagcttgaggctgtggtgtgaaaggtggccagcctggttctcttccctgctcaggctgccagagaggtggtaaatggcagaaaggacattccccctcccctccccaggtgacctgccctcttaccacactttaccagttaaccactgaagcccccaattcccacagcttttccattaaaatgcaaatggtggtggttcaatctaatctgatattgacatattagaaggcaattagggtgtttccttaaacaactcctttccaaggatcagccctgagagcaggttggtgactttgaggagggcagtcctctgtccagattggggtgggagcaagggacagggagcagggcaggggctgaaaggggcactgattcagaccagggaggcaactacacaccaacctgctggctttagaataaaagcaccaactgaactgaaaaaaaaaat

SEQ ID NO: 370506 - DNA, 301 bp, Homo sapiens
tacatatggttattcgttctgttaaaatcacagtcccataagctcaattcacattcatatttaaaacactagttataaaaaaaaaactatgtctatcatgattcaaagtttcagaatccaactaaactcatgcttttatgagttcaaaataaaaactgaaattttcattaattcataattgattacgaaagtcatctctttacttctacaatatgttatgagatagggaacaactgctgtaccttcctctaatcactccctttgctcgaaaaaggcaagtacatcagaaagcttcatgtaa

SEQ ID NO: 370507 - DNA, 2437 bp, Homo sapiens
ggatggagaacacagcatatatgagaggtgggagggcagagacgccttgcaattcctgtgaggagggacttaccgtctcctccaaaacagaaattcagtgctgcagagacggtagcaaagtgcagttctcttgttaaaacacaggctaaaagcagtgactgcttaacttattaagcagagaaaaccaaaatgtcattttcaaccaaaattgagtgttagagtttatggtctctgttatgatacttttcaagacctgggaaatatttgtatcctttagtgaaaaggggaagaatcaattactgaaagccataagcttacagtaacggagccaattaatcctttgtcatctttgttgagtttagttttcttctgttcttagcacgtcagctagtagatctttgatgaactgttgctcctctttaaatgtttcttttattatattgatgatgtgcactcattcagtattcttattttaagctgcagtaatcactgtacatttgattgccatctgtacttcccttgaagcagctttgcttattacagccacacctgcatctgttttgactagcccacataacctacacatttttcatccaaagctatcccattaccttatttatgtccatttattttcatatatagtatctgccaaaatagtagcaaaagttttatcaatgtgtagatttcaatcagaaaaacctaagcaaaaggaaaaaaaagtgatattctaaaagccacacttcttttatcaccagtgcagttttttccatcatcataaacttagttttatgaaaatgttaatatcttggatttaaacattggggtagaaatcaggacaaaatttaaatgtcatatccaggacttaatctcagatattctggtagaagatatttagataaggttgtggctgcctgtcaagttttttaattttttaaattatataatgtcagaaaattaaatcacaaatgagccttccagattgtgaggaaaattacttggctgaaaatgactttgcataatgcccaaatcttgaagtatctgctcagatgtttgttccatctgaaatgctgccaaatccatctgtattgaggaaagagctatgaggtagtttcagagaaagtgaaaacaaaacaaagcaaaacaaaaatgctattacagaagttggacagcccaatgtgttaagtattatacacctggaacaagagcagcaaaactgaagctctttggaaagttatggcaacagtggtctgggaattctgggcctttagaaataatcattcccagtgatacagggatgtgcagcatccagacactgcttaatcacagtgagctgccgtcttccctgaataagttgtatcttataacattgaagtgaatgaaaatgtattagtatttgagaatttactattccttcacctccttgcacatgtaaattaaagatgttttggaaaatatgagaacttgatgttcactgccctagagcactattctccaaccttttagattcctgcaatctgttaataaaatattgtaggacaacaactctatagactgatacatgctgctctcaatccatatactacatattaggacagcttttcttttctaaatgagcatgaatataaatagaaattctagtattttcttcacctaccccagtgaatcatctttatattttacttgggaaactgctacagttggctagtgggtcttcacttttattgctttgagaaatggataaaagacatagactatcacccctccaaaaatgtgcatatggccccatacaagacacatgtactgccagagcttggggaactccctagaatctactcctagaccaccctagtgaagtaccatagaccatattgtctagatgggacaaaataataaattttgactaagaacttactgtttagagagaaaaaatagtaaataatgttcaaaatgagaagacaataactgacaagtctgtgatttttgggttagatgagaccacttttgatttttgaggaataaaaggagttagttttttggtcctgatgtgtaaaatgattcatggggtttcacatacagacaagtagttttcttttcagcaaatatttaacatatctctcaatatatttttcaccagtttttggtaaatatgcattgctataggtataccaagttttttttgttatgtttagtaactaatttcattttttctgtatatgtaaatatagctattggaccctgcattgaaaaccttcttagtactaacaacactccttttattattaccttcatagttactttaaatgacatatttatttcgagttttacttctggctgagttgcaaagtctatgagaatgttacctcctgtctcagaagcttgttagttattgtgccacctaaatattgtaataaaagtgtttaaataaaaatcttcttaa

SEQ ID NO: 370508 - DNA, 575 bp, Homo sapiens
aagatgttcagatttgctgcatttgttttggaatgagtgcctggtgttgcttgtgcacaccccaagcctcctggcctttccaggtttccctgttgaacaggcagctctcctgcggttgggtggcacagggctgtggtgagggccccagcatccctcctcacctgggtgctcagttcctttcttgtcatcctttctctgtttgtaaagcagaaacagtcctgctaacatcacccccttcaaagatgtatgcagaatttgattttttttcctggaaaatatacttttttagtgtttaagaaaaaactcgtgctgggcatggtagctcatgcctgtaatcccagcactttgggaggctgaggcaggagaattgcttgagcccagaagttcgagaccagcttgggcaacatagtgagactccactgggcatggtggtgcacacacctgtaccagctgctcaggagcctgcaggcaggaggatcacttgagcccaggaggtggcagctgcagtgagccacgatcttgccactacactcaaacctgggcgacacggggagatcctatcttaaaaacaaaag

SEQ ID NO: 370509 - DNA, 998 bp, Homo sapiens
tttcagtacactgctctttattttggtccataaaaggagatcttgtgcttagttttggtggtaaactcagctttagcagctttgaaatgcagattagatcaattacatcacaattatatttgaaaattgaaaaacagcattatccaaaagtcaaattccaaatttatgccttttcaaaggaagtgtcatttggaaagaaactgattcacaccatgaaatatgtggcatttcttttggtttccagtctcttctatagtagtagaaggctcatgtgatatgcagacatgtgcttaatcaaatttagctttccttttcaagttaagaaaatgtatatgaagtatttctgagataaaaagaggcacagtctttttttttttttttttagcacaaacatctcctatgctgctgcatttgtcttaattccttatttgaaaatttggctttgtttatgtaatgtacaaattcctattcacttaaaacaggaccagaatagcctggaaccctatagagctaaatgatattttagagtgctgatcctcattttctcttcggtaaagaacacaacacgattatttgtatttatcttgtcgtacacacactcaggattactcactgaggaatggggctcaagtttggttgcaagacttccatttactaggctgtgtgatgttgagcaagtcacttaatctctgaggtaaaatgaggggcctgttgcctaaaattccgtgcttctgtaatttaagtataattgacccagatgtttgatgattactttgaaaattgaaaaaagatgctagtggccataagaaatttgtaccactgtgccccgagtagtgcttctgaaatagtaacacagggagaaggttgggaggccccttctttgtcatttacatagggtttgtttgtctgaagtagcagatgccaagtgttaggggtccaaagatgctaccagaattagaggagatggagaaaaggctaacggaattttcttaattcga

SEQ ID NO: 370510 - DNA, 352 bp, Homo sapiens
gcccagatgtgaggctggcatttgaagtttgcaggctctggggctcccacgggttggtcacactgtgggctgcctggcctcacagcctcgtcagccactcttcccacccctttggggacactgcccacccctgtggggactgccgcctttctgctggctgtgtgtggctttggtttagctcgatgggggttttgaaatgggttttccgtgaagttgattgaggaattggcagaaggctcactgtgtttagcgaaaatggattttagttgaagatgcagccaggtaactcaaactttgggatggctttactgacccttgttttattatcatacttgtcaaatgtagggactgc

SEQ ID NO: 370511 - DNA, 456 bp, Homo sapiens
gcacagcatggacaccacttcatgtaggggcactggactgcctagagttggaggaagggacccttatgtgtctccagaagccttcctttccattcctgtggggtctgacagttgttggaagaaggcctgcaggtccagggccgagcaggggcctccaccgtctgctgaggaacttactgtgtctctgtttgattgagcctgggcatgagataaaacacgaggtcatctgcaatggcactggtgctgtggctgtatcagcatggctctgatgtcccttcggggcaggcaacagttcagggaggacttacaagcaagctctggaacttgaagtctcaagagatgacaaatagtcaattctcaaaaaatgaagaaaagaaaaacttgtttcttcatgtttgctaaccctatctatatctatggttttggccaataaattcactgtgtttaaatcctcat

SEQ ID NO: 370512 - DNA, 1038 bp, Homo sapiens
gctgacaatctgcctcaaacacaaacacatgacaaatatagttctgcagtgaagactttagccccacggggaaagctgagactcaggagcctgatggcataaacaaggcgaaaggcttggtagcaaatcagaagacttgtttttggaagctgaaaacttacttcggcaacaacagtcctccatggctccctgtttgtgctcttgctggccaggcctgggaagccctcttggggcctctgaggcttgtaaccagccctgcttagataatccttacagcagcagctctgcacagtatcattctcccctgtacaaatgaagagacggaagctcgaattctcacacgacacccttgcagcacttgaaccactccaggattctcttctgctggtcacccaactattctcccaggtcaccggggttacttacaatcttggatttagggttgccagatttagcaaataaaaatacagcatgcctggttaaatttgaatttcaggtaaacagataaaattttagtataagtatgtcccatgcaatatttgggacatacattcaaaagacaattcattctcctgtatttcatctggcaatcctacttgaattccatttgtagagttctccctgttccattagaaatgatcacacttggaaacattggatggttctatcccatttcctgacaaatggtgctccccgcacattctctaaatcagaggcatcaagtattcgccagggtgtgtttgaaatagcactatgtgcatcctccttaaaaatgagaatctatgcatttatttcagcttagatctgtaaatattttatttgctgctgctactgagttaaaacccccagtttcatcatgttctgactggcaagtgtttgaagtgtctgattttaaaacagctctagttctcttttaattagatatttaatttaactggctgctgatcaatagtttcaggatatttgttttcagcttgatgggaatggcaaaggaccatttgtgcataaaatagcccactagttatccttgttttcagt

SEQ ID NO: 370513 - DNA, 463 bp, Homo sapiens
tctttggctttgctacctctcttcccttcccattgtttttcctcccccctcctaggttctcacatcgctttcctgtttccctctcctgcaatatggatttgacatattaatcattacagcaactgctaaaattccactgtgcttcattaatccggaggaaaataccatgtcagctggaacttactgtgtctctgtttgattgagcctgggcatgagataaaacacgaggtcatctgcaatggcactggtgctgtggctgtatcagcatggctctgatgtcccttcggggcaggcaacagttcagggaggacttacaagcaagctctggaacttgaagtctcaagagatgacaaatagtcaattctcaaaaaatgaagaaaagaaaaacttgtttcttcatgtttgctaaccctatctatatctatggttttggccaataaattcactgtgtttaaatcctcat

SEQ ID NO: 370514 - DNA, 623 bp, Homo sapiens
gcacagcatggacaccacttcatgtaggggcactggactgcctagagttggaggaagggaccctgttctcacatcgctttcctgtttccctctcctgcaatatggatttgacatattaatcattacagcaactgctaaaattccactgtgcttcattaatccggaggaaaataccatgtcagctggaacttactgtgtctctgtttgattgagcctgggcatgagataaaacacgaggtcatctgcaatggcactggtgctgtggctgtatcagcatggctctgatgtcccttcggggcaggcaacagttcagggaggacttacaagcaagctctgatggagtctcgctctgtcgcccaggctggagtgcagtggtgtgatctcggctcactgaacttcccctccccagttcaagcgattctcctgcctcagcctccctagtagctgggattacaggcccccaccaccatgcctggctaatttttaaatatttttagtggagatggggtttcaccatgttggccaggatggtcttgagctcctgacctcaagggatccacccgcctcggcctcccaaagcactgggattacaggtataagccaccgcgtccggcctactccca

SEQ ID NO: 370515 - DNA, 550 bp, Homo sapiens
gctgacaatctgcctcaaacacaaacacatgacaaatatagttctgcagtgaagactttagccccacggggaaagctgagactcaggagcctgatggcataaacaaggcgaaaggcttggtagcaaatcagaagacttgtttttggaagctgaaaacttacttcggcaacaacagtcctccatggctccctgtttgtgctcttgctggccaggcctgggaagccctcttggggcctctgaggcttgtaaccagccctgcttaggaacttactgtgtctctgtttgattgagcctgggcatgagataaaacacgaggtcatctgcaatggcactggtgctgtggctgtatcagcatggctctgatgtcccttcggggcaggcaacagttcagggaggacttacaagcaagctctggaacttgaagtctcaagagatgacaaatagtcaattctcaaaaaatgaagaaaagaaaaacttgtttcttcatgtttgctaaccctatctatatctatggttttggccaataaattcactgtgtttaaatcctcat

SEQ ID NO: 370516 - DNA, 444 bp, Homo sapiens
gcacagcatggacaccacttcatgtaggggcactggactgcctagagttggaggaagggaccctgttctcacatcgctttcctgtttccctctcctgcaatatggatttgacatattaatcattacagcaactgctaaaattccactgtgcttcattaatccggaggaaaataccatgtcagctgcctgggcatgagataaaacacgaggtcatctgcaatggcactggtgctgtggctgtatcagcatggctctgatgtcccttcggggcaggcaacagttcagggaggacttacaagcaagctctggaacttgaagtctcaagagatgacaaatagtcaattctcaaaaaatgaagaaaagaaaaacttgtttcttcatgtttgctaaccctatctatatctatggttttggccaataaattcactgtgtttaaatcctcat

SEQ ID NO: 370517 - DNA, 491 bp, Homo sapiens
gcacagcatggacaccacttcatgtaggggcactggactgcctagagttggaggaagggaccctgttctcacatcgctttcctgtttccctctcctgcaatatggatttgacatattaatcattacagcaactgctaaaattccactgtgcttcattaatccggaggaaaataccatgtcagctggtgctgtggggatactgcagcagctctctgtccttccagtgtctccagggaagaacatcttcctctcaagtgaacagtgcttaccgcttcaagcatccagtctcagcaataagaggagcacatctccaaatttataatgaaagacaagcaaagtgggacttcatggccttggctggacaccaagtgatagctaatttttgcagcagggaagacgaaataacaagtccctggattgcaattttggtttctccttctgttctcaaacaaaaaattgtttaaataataaactcttgtcttcatcataat

SEQ ID NO: 370518 - DNA, 517 bp, Homo sapiens
aacatcacgctgggtccgaccacaggatcttcacatgtgctgctccctctatctgcatcgctctttcctcttctcttgtttgcttaactcctatttaccctcgggcttaatcagcactttctcacctctcctagtctgttgctcttatttaagatcaaacagcagagaaatgtgaagtccactgacttccgggtggaacagggttcagtatgccaattaaattattgggtgctggctgggcacggtggctcacacctgtaatcccagcactttggaagggcaaggcgggtagatcacttgaggtcaggagtttgagaggacaacatgatgaaactccatctctactgaaacacaaaaattagctgggcttggtcgtgggcacctgtaatcccagctactcaggaggctgaggcaggagaatcacttggacgcaggagggggagggtgcagtgagccgagatcgcaccactgtactctagcctgagcgacagggtgactccatctcaaaaaaaaaaac

SEQ ID NO: 370519 - DNA, 413 bp, Homo sapiens
gcctaaagataatcgggattcccactcccatattcaagctgagtcacctgcaagctaccagaggaactgtgtctgggataatcaattccaccgcagggctcctcagtgacaggtctgtgtgagatcatcaccaaagccaaaaccatccctcaggcactcaaaaaccccatcctggggacacagccttgcccggtctcttcttccaggttcatatgtgtctctcagcatgtgtaaactgttggttctgtttcaatgaactctgtttacgcacaacaaatcatgaggaaaatgggatccccatttttttcttttttgagacagagtctcgctttgtcaccaggctggagagtacagtggcgcaatctcagctcactgcaaactccagcctgggtgacagagtgagactttttctc

SEQ ID NO: 370520 - DNA, 415 bp, Homo sapiens
cagagaaagcaaatattttctaatactactgaatgtttacaaaaattaatcatatactagatttaaagaaatttttattaaattgttaaaagcataagctgtactcgtaacattctttgcccatgctttaattaagggagaaattaatgatgtgtcttaggactttaaaacattcatataaagatcaagaaagtcaaaatctcttagagactaagaaaaatgaacttaatataaataaaaatctatggaatgcaacccagcagttctcaaatttacatttgtagatttgaatcaaaaattagaaactacacaaattagtttacttaaaactttaggagggaacaaatgtcacaagacacataagaaaatggaacaagataaagcaaaaataaattagaacacagaaaactagtgt

SEQ ID NO: 370521 - DNA, 400 bp, Homo sapiens
  misc_feature (28)..(28): n is a, c, g, or t
attttcagccaaaaactgcaccatgggnctcacaggtggaacttaaggcacagtatgaaaataagcctgtgcatgcaaaacaggtctcaaagtcatgcaacagcaccactacaacttgcaaataatgtcagacttgaaatgaagctacatgtctcacaagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaa

SEQ ID NO: 370522 - DNA, 556 bp, Homo sapiens
attagacctggatcacatacagcagctgagaggagcctcacaagcaagtcttgtacttcacccatgctgtcccctatatttagcaatccctcttgaagaacactcagcctcactgtatgacacacctgtgtggagaagacagcgtagcccctttgaagttactgcttggatgattaatgacgatgaagcaacaacaaagccaagacgggcatgtacactagcctgtgcatgcaaaacaggtctcaaagtcatgcaacagcaccactacaacttgcaaataatgtcagacttgaaatgaagctacatgtctcacaagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaa

SEQ ID NO: 370523 - DNA, 305 bp, Homo sapiens
  misc_feature (28)..(28): n is a, c, g, or t
attttcagccaaaaactgcaccatgggnctcacaggtggaacttaaggcacagtatgaaaataagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaa

SEQ ID NO: 370524 - DNA, 5584 bp, Homo sapiens
ctatcactaaactgtcattgaattgtactgcattagaaaggaactcaaatatgtgtgacggcaatggacatcttgtcacctttagttggcctttttcaatgagttaagcattatatgtgtgttaccaaaaaattattttttatagttcagagaaccatttttgttggatgtgtaatttggaagttttgtttacattatgtccttaggggttttctttgttttaacagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcaatttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcaggagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactagtttcccttgtataatatgtgatctaagaaaattgctaatctttccctgccattttgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaaaaaaaaaa

SEQ ID NO: 370525 - DNA, 5530 bp, Homo sapiens
ctatcactaaactgtcattgaattgtactgcattagaaaggaactcaaatatgtgtgacggcaatggacatcttgtcacctttagttggcctttttcaatgagttaagcattatatgtgtgttaccaaaaaattattttttatagttcagagaaccatttttgttggatgtgtaatttggaagttttgtttacattatgtccttaggggttttctttgttttaacagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcaatttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccgcaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcaggagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaactgtctgaaagtacatctgtcatggcaggctttaaagagagtgcatgaaaactgatcagtcattggagaagttaccaccacacacaaaggacaggttttaagtttatgaaacccaagggctaggccatggtatagacttcttctatgagtgtgtgaaaatgtgttacttttaggacgtgtatttggtgctactctctgtgaccaccaatgggtcagttgctatagaacaacaacaccacgaaacatctgtgcagttttcagagtgtcacaaagtcaataggtccttacacggtgctattgccctaagggaaatccgaactgaatttatgcacatagaattgtcaccctgactttgaagcctcaaacatggatcaaatctgttgtgaaacatcaatatatgtagctggatgagtgactattgagaaacacagtccaaacatgagcataaacagaatttcctgcaatacatcccagtaggtccacctagtttacaacttaaactagtttgtgaaacatttgtctgtatacattttatattttgtacattttgatgtaacatatcatgtaaataggcagaaacagtgaaataaatcatctgaaaagttttgtagtctttgtaaagccccaacaataagtacttggtgtcaatggacttaactggatgatgtattttctattggtttattgttcctctagcttgtaaaccagcttgcatatatttttttgcaaatgtgcaccctgtatctgtctaaattattactttgccattaaagtggaattatttattgacaaaaaaaaaa

SEQ ID NO: 370526 - DNA, 427 bp, Homo sapiens
aaacaccaataaatttgagctctgagctgcttataagggacaaagataatgatgctaagatttttagtgtagttgaccagatgataacataccaggtaaataccaaaagaatgctgaagccaggtgtggtgttgtatgcctataatcctagcactttgggaggctgaggtgggagaattgcttgagcccaggagtttgagactatcctgggcagcatggcgagatcctgtctctacaaagaaaaaaaatacaaaaacagttagctgggcatggaggcacacaaacctgtggttccagctacgtgggaggctgaggcaggaggatcccttgagcctggagttcaaagttgcagtgagctctgattgtgccactgcatgccagcctgggttagggagcaagaccgtaccaaaaaaaaaaaaaaaaaaaa

SEQ ID NO: 370527 - DNA, 4237 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttat

SEQ ID NO: 370528 - DNA, 1878 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaagctataatttaaggagtaaattataaaggaggctactctggtaaggggtaatatttatagaaaggaaacagaaaagcaaactttctatttg

SEQ ID NO: 370529 - DNA, 2548 bp, Homo sapiens
gttttagccagtttcttgggtcctagttaactgcttttgacaaagcaacttgatatgtataactcaaggctacatattatcataacaccaagggtgatgaggaagccatcctgacatcattcacattgatcagattcatcttcatcatgttcccctaatgtcatgagtatgtgttttagaaacgtgagctctgtgtgattgtacattgttgtctgttttttccctcctcacttgtgttttccattcagcttttccataaactcccggctagccagttctctagggaacttgaatgctgcaacagatgatccagagaacactcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttat

SEQ ID NO: 370530 - DNA, 2428 bp, Homo sapiens
cgaagaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgtgcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaagatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaactgggaaaaaaa

SEQ ID NO: 370531 - DNA, 3800 bp, Homo sapiens
gatgagagggcgtggagaaccagatgggaaactttttgtcccgtgagaacaaagtacaagttatatcagagtctgatcggttatattttgctactttaaggaatagaccaaaaagcacagtaaatacccactatttctccatcgatgaggagctggtctatgaaaatttctatgcagattttggaccgctgaacttggcaatggtgtacagatattgctgcaaactaaacaagaaactaaaatcatacagtttgtcaagaaagaaaatagtgcactacacctgttttgaccaacggaaaagagcaaatgcagcatttttgataggtgcctatgcagtaatctatttaaagaagacaccagaagaagcctacagagcactcctgtctggctcaaaccccccctatcttccattcagggatgcttcctttggaaattgcacttacaatctcaccattctcgactgtttgcagggaatcagaaagggattacaacatggattttttgactttgagacatttgatgtggatgaatatgaacattatgagcgagttgaaaatggtgacttcaactggattgttccaggaaaatttttagcatttagtggaccacatcctaaaagcaaaattgagaatggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaagctggtcttggaagaacagggacattgatagcctgttatgtaatgaaacactacaggtttacacatgctgaaataattgcttggattagaatatgccggccaggctctattataggaccccagcagcacttcctggaagaaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggataacttagaagatgatgatgtggaaatgaaaaatggtataacccagggagacaaactacgtgccttaaaaagtcagagacagccacgtacctcaccatcctgtgcatttaggtcagatgatacaaaaggacatccaagagcagtgtcccagcctttcagattaagttcatccctgcaaggatctgcagttactttgaagacatcaaaaatggcactgtccccttcagcaacggccaagaggatcaacagaacttctttgtcttcgggtgccactgtaagaagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatcccttcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtattttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcctattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttat

SEQ ID NO: 370532 - DNA, 254 bp, Homo sapiens
tgctattcaattcaacacaatcaggacacacaactgccagtcagaacatcctccccataacccttagtggaggagatctgaatcttgcgttttagtttccatggacttgcctgaaagtaagcttatttggtcatgctttgtgggtggcaacaggtgacttagtccagaccacctctggaagctttgatgtcagatacgatgtccagtcgcctcagaacaggccaatagctgttgcattttccaggtaccctgca

SEQ ID NO: 370533 - DNA, 1553 bp, Homo sapiens
atctttccatatttactgagtttaaatgaatcatctcagagagaaaagaaaaactaaatatggaaagatgcatggcagaagctgaaatgagctcaagcagtactaaccttggaaccattctgggtacccaaaagaaaaatttaaaatcaagatgagtaaaaggagaatggtctcaatatcctcaaaaatgcagtaagagaagtaattccccactgaaaatgtctctctttctttctatgttataccctggagtcctggttgaggggtgggggaatcagaaaagtaggtttacatttaacatttttcttaactacattcacttcttaaaaaggaacaagaagtgtaaataagtatgtatagagtgagggattaagcatatttgcattggggactcgtgtattatgcttttaagtcaaaattaatattctcaaattcgaatttgatagctattatttctaaatctttttaatcctcaattttcctggtaaccttctttcaagagtctccttcttctaaaagttgccaaaccctttatatttaagctttttccactcaggactcaattagagtggtcaacagggagagggatggtcccatttgatctttgccactgagcaaaacaaaacttcaaatgaacttttaaactgtagctttagtcttctggtataaagtggggaagattacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaattattcccctct

SEQ ID NO: 370534 - DNA, 2197 bp, Homo sapiens
ggcctgcgcgcgcggccgccctgcccacgatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 370535 - DNA, 3648 bp, Homo sapiens
ccacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccacttttctatatttagtttttcttttctctctgagatgattcatttaaactcagtaaatatggaaagatgcatggcagaagctgaaatgagctcaagcagtactaaccttggaaccattctgggtacccaaaagaaaaatttaaaatcaagatgagtaaaaggagaatggtctcaatatcctcaaaaatgcagtaagagaagtaattccccactgaaaatgtctctctttctttctatgttataccctggagtcctggttgaggggtgggggaatcagaaaagtaggtttacatttaacatttttcttaactacattcacttcttaaaaaggaacaagaagtgtaaataagtatgtatagagtgagggattaagcatatttgcattggggactcgtgtattatgcttttaagtcaaaattaatattctcaaattcgaatttgatagctattatttctaaatctttttaatcctcaattttcctggtaaccttctttcaagagtctccttcttctaaaagttgccaaaccctttatatttaagctttttccactcaggactcaattagagtggtcaacagggagagggatggtcccatttgatctttgccactgagcaaaacaaaacttcaaatgaacttttaaactgtagctttagtcttctggtataaagtggggaagattacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaattattcccctct

SEQ ID NO: 370536 - DNA, 801 bp, Homo sapiens
ggcctgcgcgcgcggccgccctgcccacgatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggagttcatggcctccttgatgcccagcctcctacattctagatgtccagaggctccaggcagggccagcttcatggaaatacaaaactgcaaccgcacagggccttgcacttggaagggccctgcgtttggtaatgttctgctatcaccgtctgctggcttaataattttcaaagaggctctggatcttcattttgaactgggtcctacaaattatatcctgaccccaggctgacaaacttggtctaaaactaaccaaataacagtgtttgaacagcaatcccacatttacggtgagttctccagtacaaacctgaaatttatctgctgctcacttaggtgctcttggacatgtcattcagtcttcctacatttcagtttcctcattgacaaaataaagacaacagatgacaccttctactttctttattttcaaggttgtactatctctaagtaaaaagaggtaata

SEQ ID NO: 370537 - DNA, 2032 bp, Homo sapiens
ggcctgcgcgcgcggccgccctgcccacgatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattatgtagtttcacttatttccttcaggctttttatcagcaagaagcaatgtctgattttgataccacccatttgctatgaaaatataagaaggcgtcatcttcaaagcaacactccagttgggcttcttcatcgtttagctgcatgatttcttctacgacatttgtaacagaca

SEQ ID NO: 370538 - DNA, 493 bp, Homo sapiens
atcttttacttaaacctttaataaagattcaaataaaatgttaagaaactttctaaatggttctgaaagtaatggtccagccagggaaataaggtctctcgcctctgtcttggggctttcagaatagactggatgaccttagaattaaaggcagattcatgtttttctgaacagtacctccttgtattgacaagtgtttccccaatagtttgttttacagtaaatgcttcaactaaagaatccaattattaacccattcacactgtttcagtttgcagataaccatttgcccagcacaaaaatctttatattgttctcagaaattgattcttgactctacacagcaaatccttcgtctttattgttttgacccattacaaatgctttccactatgatggacttatattctccttttctcctctagcacttactttcttttttccccaggagtccaagtcttggcaacctttgaaaaaatcccatttgagagac

SEQ ID NO: 370539 - DNA, 496 bp, Homo sapiens
agggtccaacctatgtctcccaaattgaaggtcactcgtctatgtagaagaaacctcaagtggacaaagtgactgtccagcactgcaattctggcaatctataatctctcttgcctctcaggtattcaactttgacgtgcgccagttgaactggttggaatacattgaaaattatgttttgggagttaaaaaatacttattgaaagaggatatggctgggatcccaaaagcaaagcaacgcttaaaaaggtaagtataatcagtcagttaatatttattgagcacctactgtgcatcgactttataccagacataacatttgtgcagaggagaatgaacatttcttgagcatttactacattacaggtcctgcactccatactctaccctgtaacacagtttcatttagacttcaccacacctctatgaggcaagtattacttttgttaccccatttttatgaggcagatatctagatttaaacacagcaaataac

SEQ ID NO: 370540 - DNA, 2095 bp, Homo sapiens
ccacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccagagaaactagacaaaaaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactccc

SEQ ID NO: 370541 - DNA, 3829 bp, Homo sapiens
ggcctgcgcgcgcggccgccctgcccacgatgctgtcgcccccgcgacctgtagggccttcgctggcccctcaccctcctcccgccccgggctgaggctgccgccggtttcgcgcccagtgccgaggcagcggcggagccggggaaggtcggagggagggtggtttcctcccgccccacacccagtctccgagccggatatatagagtgtcacgtttgggagccgaaagactggagccgtttccttgtggctggagcgcttcccgtagcctcggggaaggagcaggatttagaggaccactagttggaccccatcctcgtgctggaggaacaggaacctctttcaggagctataaaagaaagggaggaatcatgtccacaattgcagctttctatggcggcaagtccattctcatcacgggggccacaggctttctgggcaaagtgctaatggagaagctgtttcgcaccagcccagacctgaaagtcatttacatccttgtgaggcccaaggctggccagacactgcagcagagggttttccagatcctagacagtaagtttgaaagctactgatgcgaagattgctctgggcagttataaagggaaatgagttgtatgcagttattcatctgcaatgctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggatgacaaagctcatgaatcggcttttaagaactgtttccatgttggagtatttcatcaaccggagttgggaatggagcacgtacaatacagaaatgctgatgtctgagctgagtcctgaagaccagagagtattcaactttgacgtgcgccagttgaactggttggaatacattgaaaattatgttttgggagttaaaaaatacttattgaaagaggatatggctgggatcccaaaagcaaagcaacgcttaaaaaggctccgaaatattcactacctctttaatactgccctcttccttatcgcctggcgccttctcattgcaagatctcagatggctcggaatgtctggttcttcattgtaagcttctgttataaattcctctcctactttagagcatccagcacgctcaaagtttaagagcatttagccatcgccttttatctggaacctctcagatacctctaaaacagcaaactgtgattctcaagattagaaagtaacaaggaatatgcccaaactgtcaaatgtcacctgttatgtattcgtccctattccttaactatgtatttttatttcagtgagagaaggaaagttgtaaactagcccatagtcacctatattttagggaaaaaaatccaaattgtttcctaacattctattttatgcccttgcgtattaaacgtgaaagtactcccacttttctatatttagtttttcttttctctctgagatgattcatttaaactcagtaaatatggaaagatgcatggcagaagctgaaatgagctcaagcagtactaaccttggaaccattctgggtacccaaaagaaaaatttaaaatcaagatgagtaaaaggagaatggtctcaatatcctcaaaaatgcagtaagagaagtaattccccactgaaaatgtctctctttctttctatgttataccctggagtcctggttgaggggtgggggaatcagaaaagtaggtttacatttaacatttttcttaactacattcacttcttaaaaaggaacaagaagtgtaaataagtatgtatagagtgagggattaagcatatttgcattggggactcgtgtattatgcttttaagtcaaaattaatattctcaaattcgaatttgatagctattatttctaaatctttttaatcctcaattttcctggtaaccttctttcaagagtctccttcttctaaaagttgccaaaccctttatatttaagctttttccactcaggactcaattagagtggtcaacagggagagggatggtcccatttgatctttgccactgagcaaaacaaaacttcaaatgaacttttaaactgtagctttagtcttctggtataaagtggggaagattacacttatgtgatcaccaaaggatttactagtatcttggtcattccaattgcacaatgttaactgtacaacacacagcagaaaagtgaatagacttcactaagggattctaagtttagaaaataggttttgttttcttaaaaaattttgtgtataatacaaactaatgaaaactatacatattctccaattcctatagtaataataatgtaactgttacaccaactttcctcatatttgagagatgagtacatgttggattgcagcatttcttcatgttaaaaacatggaatattattcaaatatagtacttggggcctaaacaactaaaattagtcaccgcataactagttgaaaatggcataggcataaaatgttaataaagaatggcagttatatttatgctcacttcctggagtaattgggtaatattcagaaaggcacatcgtggtagtttaagtgtacaaggccttagggcagtatctagcccagtattattccagattctcctgagctctatataaagggcattttggaggaactcttctgggcaatatctttcccaatctcatctaaattctgggaaatattttccatagcagacaacccagctctgaaactaagcacctggtgatctttagtttgagatgtctatatggtacttttgagttatatcaattaagatacaagctatagacatgataaaaatatgaaatcaagatatagctcagtgggattggattaagacataataatagttctaagaattcacttttgattgtatgttttaccaattcaataattccactaatcaagtattcacattttgacttttgattaaataaaaatttgaattaaaattattcccctct

SEQ ID NO: 370542 - DNA, 3589 bp, Homo sapiens
tcaaacgcgcgacgcgagggcgggggcgccgcgtgcgcgcgcgctctcgttggttcgctctctcgctagctctcggctgccgctcttgctgcgcctgcggctggggctgggggcggcggcggcggcgacggggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttta

SEQ ID NO: 370543 - DNA, 7827 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370544 - DNA, 7919 bp, Homo sapiens
tcacgccatgtcacaaacaagaacagttgaaacttttctgtgaaacatgtgatagattgacatgtagagactgtcagctattggaacacaaagaacatagagattgacagaatgtttgctaatatttcatttagaaatgtagagtcaatacgctggagtggtctgcagttttcttcttttgcattgcctttgttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370545 - DNA, 7723 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370546 - DNA, 7626 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaattggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370547 - DNA, 6883 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370548 - DNA, 5949 bp, Homo sapiens
tctgtctccaaaaaaaaggaggtatatatacatgtgcttgtgcctgcaggtatgtgtttgtgtgttctaggttttgaccacgaaaaaagaactgatttacttgtggcattttaatacatgccaaaacagtacaagatacctgagaaactctgcaacctgtgctcttcttcttcataaataactgagtccacataatggtgatactgggatctgagagaattggtcttaggccttatgctgcaagtactgctcatcactactaagagacccccttttaatgcggaggtgccatttttataatgcattccagaaagtaatcaattgatgcgtgactaggaaaatttagaggagtttttaatcacatgacttcacctgacgagatttcacaactataaaacctcccttttttcaaaaaattattaagaaaataaaccaggccccagtccagggaagtagcttctctagagcaggctttcttataattacgtggactaattgcctatttccctgtctagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370549 - DNA, 4693 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaa

SEQ ID NO: 370550 - DNA, 3541 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttggtaccgtcgacggagatcctctagat

SEQ ID NO: 370551 - DNA, 3065 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggtaagcttttcagaccatgcaaacttggtgaaggaatatgcattaccaataggtgaatattcctatcttttgcttgcaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttta

SEQ ID NO: 370552 - DNA, 1151 bp, Homo sapiens
agagagagagagagagagagagagagagagagagagagagagagagagagagagagagagagagagagagagagatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370553 - DNA, 1686 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggtttgtatttgagttgaatgaggcttcattaaacttaatgttaattacaga

SEQ ID NO: 370554 - DNA, 552 bp, Homo sapiens
agggctttgtaaagaaaatggttccatgttctgtagaattttagaaaagcactttatctggttatagcaatttgttctccctagtatggctgacttttcgtcgccaatcctatgcagtctcataactttagaaaggattataatttcccttttttttttttgactctggtatcctttttagatgatgaaagttgttcaagtttatgcagacacacaagagattaatttgaaggtaagcttttcagaccatgcaaacttggtgaaggaatatgcattaccaataggtgaatattcctatcttttgcttgcaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttta

SEQ ID NO: 370555 - DNA, 409 bp, Homo sapiens
aatgtgaacgtcttctgctttacctctattgccatgaattaagtattgaattccaggagcctgttcctgcttcggtgagttgcctaccttagtagctcggtggggaagtctcataatacttaagagtatgggctctggcggccgggcgcggtggctcacgcctgtaatcccagcactttgggaggccgaggcaggcggatcacgaggtcaggaaatagagaccacggtgaaaccccgtgtctactaaaaatacaaaaaactagccgggcacggtggcgggcacctgtagtcccagctactccggaggctgaggcaggagaatggcatgaacccgggaggcggagcttgcagtgagccgagatcgcgccactgcactccagcctgggcgacagagcgagactccgtctca

SEQ ID NO: 370556 - DNA, 7776 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370557 - DNA, 7239 bp, Homo sapiens
tctgccttgcatattttggcaattcaaaggcagatggaatcagtattggcaatcttgagtatccttgagtaagtcttgtcatgggagaattgatttagattgattagataggcctcttctaatagataatctcttttactgtcttaattttctgtatgtctaagtaaaaaagaataaggacagagagtatatttttctgaataaccaaacgtcatttattcagctttggaatgtattaagtttctgatcatcatcatcatctttaaactgactccattccctgctgtactgttggagctttgaggtgctgatagttgtcagaggaaagaggaaaacatggtgattactcaacaaagtagatgatttagttgattatatgcaaattctcattttttaaatttttcaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370558 - DNA, 6601 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatatttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 370559 - DNA, 6890 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaacgaaaaaaaaaaaaaaaaacacaaaaacccagaaaacttttaagctgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagatggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggatattggtttcttttcttggtc

SEQ ID NO: 370560 - DNA, 3058 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggcaaacgttgttccgatgatgcactcctggtatgagtttggagccagagagaagacccaggaccaaaatgtgttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttta

SEQ ID NO: 370561 - DNA, 3425 bp, Homo sapiens
tcacgccatgtcacaaacaagaacagttgaaacttttctgtgaaacatgtgatagattgacatgtagagactgtcagctattggaacacaaagaacatagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttctaaccagtgcatagtatttctataaaacagggagcctgttattcttttggtattagcttccagagaaactaacaataaaatatctaagatctaagtagtacattaatgttaaagagtagatttcatctcctggcctttagtttatattcagtataaggaaaatagataaaactctaaattaatagggggctaaggttacaaaacctgcagtctggttctaattctgtagtaagcttgagcaattcactaattatcagggatcagtttttgcatctacaagtggtaggttttggtttagcagagctgtagttcttcccttccatttattattttatgttcatgcaacctcttgtctcttgatttcagagaccataaaatagtagagtcatacttgtttttttcagtcttctccttcctctcttgtcccccaatttctttttggtgaaagtaagtcagtattcttggggtaaacccagcttttttcttgctataaattgaaaaaaaaaaaaaaaaagatatatcttctcaaattcctgagaagcagtaactttaattgaataatagtgccctctttgaaagtgttaaccttttggattagaaaactagtagatatttaaacagtgccagaatatttttctgaagaattgtaatttcttacctaagtctttggagatagagttatttgctagagatgtaataagggccttctttttctttactcttatttagaaaagaaaagcattggcactttgatcttgaaattaagaattttcttttctttgggtagtaatatttactggaatgtcagaattttgccactgaatgccttctttcaatagcaaatgctttgaaagggttgtaaaatgttggcgtaaattagccaggtgtggtagctcacacctgtaatcccagcactttgggaggctgaggcaggcggagcacttgaggtcaggagtttgagaccagcctggccaacatggcaaaaccccatctctact

SEQ ID NO: 370562 - DNA, 3538 bp, Homo sapiens
tcaaacgcgcgacgcgagggcgggggcgccgcgtgcgcgcgcgctctcgttggttcgctctctcgctagctctcggctgccgctcttgctgcgcctgcggctggggctgggggcggcggcggcggcgacggggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaactgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttta

SEQ ID NO: 370563 - DNA, 1847 bp, Homo sapiens
  misc_feature (1828)..(1828): n is a, c, g, or t
gaaactgagatatggttcccatacaccaggaacataaaccatgaagacagtcataaaatattaaaagcttaatataaacatataagctttgtcacggtttaagtacaggaagcttcggagttacaaatgcctactgaatacctgtttttgagaaacaaccacaatcattgaatttcacacgtgatatttcttttggctttggtgatgcccagggatgctcttcttgtcattcctgagagtgacaatgtctccttgtgagtcagagaggagagaaggggacatgccaagtcacatggcacccccagaggcttgagctccagagaaagatctcttcccagcttcccaaagtccagcttggaagtcaggacacgttttccttgaaaacaatgaggaacgacgacaggactaataatacattgtaggttaaagaggcttccatgggccagctggaaatccaaccaccatttattccaagttctaaacaatgaaagtacaagtaaacttttcaatgacaagcctgccataatttggggtctgcttgtacataattaattccaaagaagtgatacagacggtaattgctatgaattcagaaaagggaacattttcccaaagttatgtgggtctcagagccttcttgagaacattgagatggtctagaattgagggcatgtacgtaatgaaaagatgtcatttgggaaagaccaactagtctctatccaaaatttgctatacttttaccatcatggtacctataaaaatgacatctcgatatgatgttttgccagtctcagaaatcaagtgctgaccaactgaattgttatttcgttcacaggagtggaatttcatggttaagtcatatttgctagttattccttagactcctgagttcaggcatcagatacttgataaacatactagaccaactaacagatttatgcagctagctctattcttacaccagggatactctgtcagaaatgccaatggaatagcagccacaaggtctgtgtgctactttaaacaaatcaatatctcaaaaggaaaaggcgtcgtctgtcactaattagatcaaattaaaatgtgctgctgtatctcctttgaatattcatgaggtgctctcaatcagaagccctaagtctgagaccagaaacttaagccagaaaaaactaaatactgtgagattcagataactcggtcctttgccaactagaacttcaaagagaagaggaatagcttaggtgcagagtaagcctcctgaaaagatgacaaaatcagcttaatgcagaatcgtggggttcccacccaacctaaagatggatcgtcaaaatagcccaggagctgataatcctagactctgttgacacacaggacacatagtttagcctctcttgtgatttacttgtccttctgtctggcggaaaccatggagattacacttgtccttatttgaattctggacttcatttttcatgaatgaagtgattcaaaaaatacagctgggtctaagcatgaattctaactttcaaaaatcacagatcttaaaaagtctgtattgaactgggtgcagtaactcatgcctgtaattccagcatgttaggaggctgaggcaggagggccacttgagccctggagttcaagaccagcctgggcaacagagtgagatcccatctctacaaaagactttttgaaaaattaggtgtggtggcacatgcttgtagccctaggtgctcaggaggctaaggtggaaggatcacttgagcccaggagttggaggctgcagtgagctatgattgcactactgcactccagcctgggcaacagagcnagatcctgtctcaaaaaaa

SEQ ID NO: 370564 - DNA, 1420 bp, Homo sapiens
agcgggggcggctcccggcgtgcagcttggtggcggctgagccggcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370565 - DNA, 1518 bp, Homo sapiens
agcgggggcggctcccggcgtgcagcttggtggcggctgagccggcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370566 - DNA, 1524 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggtgaggtccctctcccaactcccctgatgtttggatgaaggacagcatgtgacaaggggcccttcaagtcaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370567 - DNA, 1440 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgactgttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370568 - DNA, 997 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaaaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370569 - DNA, 1039 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctataactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370570 - DNA, 1416 bp, Homo sapiens
  misc_feature (1285)..(1285): n is a, c, g, or t
  misc_feature (1291)..(1291): n is a, c, g, or t
  misc_feature (1298)..(1298): n is a, c, g, or t
  misc_feature (1308)..(1308): n is a, c, g, or t
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaacttaanttgggntgtcccntgggaaattnacggcggctccaaggctaatagccgggggctcccgtaacgggggggccagcgaagtgcccttgaaaaaacgctttgggggagggggggggcctagagcttaaggcgag

SEQ ID NO: 370571 - DNA, 888 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgactgttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaagaagaaaatactgattctacttatatttttttatccaaaaataagaaaggcaaatattacattaccttctctgttccctcatttattcatctaataagcacaaaacggactgtgagtcagccctgaaggaagatacagggcatgcctccgggggcctcgaagttggtggagaaatcctcccttcccaaaataaatgatgttgagcaca

SEQ ID NO: 370572 - DNA, 878 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggtgaggtccctctcccaactcccctgatgtttggatgaaggacagcatgtgacaaggggcccttcaagtcaggtataggtaaaaagagctgtacgtggggtttctctgagggcccactgctccaccctgtggtgagagtttcccaggactttaattactggactttgggaattagcacctgttgtgatcaagggtcagtggggtgagctggtgctggccttactgaggccacagtttgaatgcttctccttgtgactgtagctgagtctggtcatgtctccaggctctggctcccttctctgcagtcccttagagttaggacaggggttctcagccggggtgattttgctactgccccagggacatttgagcaacatcttaggatattttgggttatcaaaaccgtggtgagggagtactactggtatctagtcggcaaaggccagggtattccagggattccctgcagtgcacaggagagccacccttcccatgacagataatgatcagccccaagtgtcaatagtgccaaggtggacacacc

SEQ ID NO: 370573 - DNA, 418 bp, Homo sapiens
ttgcttcttgcactttgggcttagcacatgcactgatctctttctgtgtctcatccttccagaatgacagtccttaccaaggaggtgttttcttcctgaccatccactttcctacagattacccgttcaagcccccaaaggtgaggtccctctcccaactcccctgatgtttggatgaaggacagcatgtgacaaggggcccttcaagtcaggtataggtaaaaagagctgtacgtggggtttctctgagggcccactgctccaccctgtggtgagagtttcccaggactttaattactggactttgggaattagcacctgttgtgatcaagggtcagtggggtgagctggtgctggccttactgaggccacagtttgaatgcttctccttgtgactgtagctgagtctggtcatgtc

SEQ ID NO: 370574 - DNA, 704 bp, Homo sapiens
tagaggcagcatccccagcatacagcagctctgacccactctctcatgttctaggaattaaccgacttgcagagggatcctcctgcccagtgttctgcaggacctgtcggtgatgactgtaagtattttggggggcttcaagttgtaggagcattttaattaagaccccccaacttaggccaggtgcggtggctcacgcctgtaatcccaacactttgggaagccaaggtgggtggatcacctgaggtcaggagtttgaaactagcctggctaacatggcgaaaccccgtctctactgaaagtacaaaaattagccgggcatgctggcacatgcctgtaatcccagctacttgggaggctgaggcaggagaatcgcttgaacccaggaggcagaggttgcagtgagccaagatcgtgccactgcactccagcctgggcaacagactctgtctgaaaaacaaacaaacacaaacaaaaccaaacaaccaaattatcagccaagcagtatttaagaaaaccaatcaatgcttttcccttcattttctcttgaatggcttttcatttgaggtctaggccatgagttcacagcagcttggctggtcagcttatactcaaagtagaacctgcactgcctctcatgtcccatagtcaccgcttccctcttctggcgcatgagaaagccagttggctctgaggagtcacat

SEQ ID NO: 370575 - DNA, 1452 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370576 - DNA, 1420 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgactaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370577 - DNA, 1621 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaagagtttcgctcttgttgcccaggatggagtgcaatggcgtgatctcggctcaccgcaacatccacctcccaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370578 - DNA, 1267 bp, Homo sapiens
agcgggggcggctcccggcgtgcagcttggtggcggctgagccggcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaa

SEQ ID NO: 370579 - DNA, 1714 bp, Homo sapiens
  misc_feature (1460)..(1460): n is a, c, g, or t
  misc_feature (1464)..(1464): n is a, c, g, or t
  misc_feature (1470)..(1471): n is a, c, g, or t
  misc_feature (1476)..(1476): n is a, c, g, or t
  misc_feature (1479)..(1479): n is a, c, g, or t
  misc_feature (1482)..(1482): n is a, c, g, or t
  misc_feature (1486)..(1487): n is a, c, g, or t
  misc_feature (1496)..(1496): n is a, c, g, or t
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaagttctcttgtccatctgctcgctgctctgcgaccccaaccccgatgaccccctggtgccagagatagcacacacctacaaggccgacagagagaagtacaacagactagcaagagagtggacacaaaaatatgctatgtaagtgccttggaggttttacatgagacactgtccaagagaagctggcagagaggtcttcccttaaaactttgggctgttggctgagccattcaaagagcatcatctgttcttcaaacaaatgttggtcacccactctctccagctgcagcatgttggtgccattttcagcaattacggctttgacagtgccacctctttgatgccaaatcagcaaccattgttgttatgatctgcagtcttcctggtgacactggaatctctctctctgccgcctcagtttgtctgctggtctcttggggggccaggccctgcacgtctctcctacccggcctcaaatggtgctgctgcccatgatggtaccacaccagggcctcagcctggcccctcaccacataccctttgccttttagaactcagtgccatcctgggtgcccagggcagagcaggctttgttcgcacctcatctgctgcagaaccacatcctgaggagtctcagcttatcctggagggaattgggaacagtgtcactgggaagtgaaggcctagccctgtggcttccaccagtctcctcctgcagtgccacgtggtggcatttctcgcctcacaccaagaagcagcaagtggaaaatttcaggatacaaagcacataacaccccataagagatgattatgtttttagaagcaagagcaaaattatgaaacctctagagatttgggtcatgttactccatttgatgaagattctcactaccgcccgctcctcccataggagcctacactaagtccaagtgtgagccattcacagactagaacacaaggagggagagagactcttaaacgtaaataaaaatgcaattcactcacaactctaaaaaaacaanaaancaaaannaaaanaanaanacannaaaaacaanaaaccaacgacggccaccacaggcaaacactaaagataaggggcaaagaacaggaggagagcaaaaacaacggagaatcgcgacaacacagggaggaggagaaccacgaacagaagaaacatacaaaataagggagggcaaaagaaaagaaaaaaggcaggacaaaaggcagaacaagagccacagaaaacacaacggcaaaagagggaagagagaag

SEQ ID NO: 370580 - DNA, 900 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccagcgttgactgtgtcaaaaggtagagatgctgatggcatgctctgtgtgctcttttacacatgtttttaccccagcactgactgagtggaaatggaagctcagagaaagaagtcacctttcccaggtcacatagccctgtccactgctgtgcccttaagtggatatccttacacgcctacgaggcagcaccagcagaactttgtgccccgctccctggcgcttctcagcagtcaattgccctggtgtgctcaagactgtcacatgggtgcaagaagaaaatactgattctacttatatttttttatccaaaaataagaaaggcaaatattacattaccttctctgttccctcatttattcatctaataagcacaaaacggactgtgagtcagccctgaaggaagatacagggcatgcctccgggggcctcgaagttggtggagaaatcctcccttcccaaaataaatgatgttgagcaca

SEQ ID NO: 370581 - DNA, 677 bp, Homo sapiens
gagagagagagagagagagagagagagagagagagagagagagagagagagagagagagagagagagagagagagagcagcgggccgcctcaggcagccccggccgggccgcccgggtccccggcagcggggtaggatggcgctaaagcggatccagaaggctgtacaagaagcatggtgccagcatctgcttctggtgaggcctcaggaagcttacaatcatggcagaaagcaaaggagaagcaggcgtgtcacctggaattaaccgacttgcagagggatcctcctgcccagtgttctgcaggacctgtcggtgatgacttgttccactggcaggccaccatcatgggcccgaatgacagtccttaccaaggaggtgttttcttcctgaccatccactttcctacagattacccgttcaagcccccaaaggttgctttcacaaccaaaatttatcaccctaatatcaacagcaatggcagcatctgccttgatatcctgcggtctcagtggtctccttcagacttcaagtctgaaggagacaaagaggaagggcagggtctatgtcatggacactgctacttgttcgatgaagctggccaggtttatgtcccgttctgaaaggccggcacactcatgggtgctcagcgtgatgtggaccttgttgtacacgttaa

SEQ ID NO: 370582 - DNA, 1018 bp, Homo sapiens
  misc_feature (8)..(8): n is a, c, g, or t
  misc_feature (88)..(88): n is a, c, g, or t
  misc_feature (113)..(113): n is a, c, g, or t
  misc_feature (134)..(134): n is a, c, g, or t
  misc_feature (137)..(137): n is a, c, g, or t
  misc_feature (201)..(201): n is a, c, g, or t
  misc_feature (218)..(218): n is a, c, g, or t
  misc_feature (247)..(247): n is a, c, g, or t
  misc_feature (255)..(255): n is a, c, g, or t
  misc_feature (302)..(302): n is a, c, g, or t
  misc_feature (313)..(313): n is a, c, g, or t
  misc_feature (356)..(356): n is a, c, g, or t
  misc_feature (388)..(388): n is a, c, g, or t
  misc_feature (529)..(529): n is a, c, g, or t
  misc_feature (532)..(532): n is a, c, g, or t
ttttttgngtataataaatccccagtctcctgttagccagctctatgtatattaaactgttctctattgcaatatccccgtcttgatnaatcagcattgtctgggcagcaggnaaaatgaagcaatttaggtgntangagagccaccgccatttggaacaggggcactctgaccattgactagagctgaagtgaacctgtnacagtaggtacctagtnaagcaagaacagtgctagggaggcccccngcccctcnccaggaatgtcaggcaatcatcaggtgatggtcagggagtttttttntgtttctctanaatagtgactggtcaccgccccaggtaaaaacagtcccctaancggtagaaagaacctgaaactggtgacgcacngcttcccaataatatctcaggagttgggcaagtcgtctcaagtatgtgcattaagaggtgaagtggtgaagtttaattgatatatgaccttccagggacatttccctggtaaggaaagaatacctcaagtgaacatgtgtnccnctccagtatacacactctgcatgctcccctcccaagtgctagcaggccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcaaaaaaaaaaaaaagtcgacgcggccgcgaat

SEQ ID NO: 370583 - DNA, 139 bp, Homo sapiens
gcggccgcctactactactactactgctcgaattcaagcttctaacgatatacggggacatgtgtagtcacttccaagtgcccactgcctttccatcctgcaattgtggcctgtgtataattaaatgattttagcctca

SEQ ID NO: 370584 - DNA, 4637 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcacgtgttgcttctgttttcctaaatactgtagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaactactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacacatgtagtaatattatttctataacttactgttataaaacactaatttttaaatgatgagataaaaagaaatatctagaactagttctaacattgtcttcccctatgcatatggtaacgaaccattttacaccatactattttggagaccacaattttttttgcgtttgagatggagtctcactctgtggcccaggctggagtacagtggcatgatatcggctcactgtgacctctgtctcctgggttcaagcaattctcctgcctcagcctcctaagtagctgggattacaggcacctgcctccatacccagctaatttttttatatttttagtagagacagggtttcaccatgttggccaggctggagaccacaattttttaaccacagtgtagcaacactcaagtgggattgcgaatactgttactaatggttaatgtcacagcttgccttttctatattccagctgactaaaggtcatctcactcacttgccttctgatgtgttttcatgagttgaggggaaagggtgtcagtggcataacttcaggaagacccagggaaaagtgcttgggtaggtgaaactgtcatgtgtgccaagcttggaaaatagtttgagactcatggctgtaggcaccatccaaggccaattttccaattctggaaagccaaatctgaatcttagaatacctcacaagtgttaaaatgtgctttttagtgtctcctttatctcagtgtgtttatgatctgtcaacacataatcatcttttatacactacaaaaagggactcgggtgtctgaggggagagaatccctaggagcccaactctgatgttgctgtcagttacatcatctacagcagcacctcttagattgtgaaggatggtgtaacttaaaagattgtgtttctgcactgaagatagatacacagtgatagtgaagtttgttttccttatagtacttcattttgcatcttgattgctttttagggcctggggccaatgtcaacaactcttaggtagcaaaagaagaattagaacatgggcatcttttttatacctctttcagataaaagctatgatgttcacctgtaaaatatatggtttctctcttt

SEQ ID NO: 370585 - DNA, 2811 bp, Homo sapiens
aacacgataaaggggacatgccgggagttgcagtaccctcaggaagaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctca

SEQ ID NO: 370586 - DNA, 2962 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctca

SEQ ID NO: 370587 - DNA, 2339 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgtgcggtgtttggggatcctcagagtcac

SEQ ID NO: 370588 - DNA, 1449 bp, Homo sapiens
cgctcacaacatgctaagggcatcagtgaattcatatttagcacaggacatgtcaatggttgattccaggtcaattttagaaatatcagaaagccaggaccggaaatcttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctca

SEQ ID NO: 370589 - DNA, 1899 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttt

SEQ ID NO: 370590 - DNA, 1548 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctacagttgatcccatcgtggggaccctctagacc

SEQ ID NO: 370591 - DNA, 987 bp, Homo sapiens
  misc_feature (8)..(8): n is a, c, g, or t
  misc_feature (88)..(88): n is a, c, g, or t
  misc_feature (113)..(113): n is a, c, g, or t
  misc_feature (134)..(134): n is a, c, g, or t
  misc_feature (137)..(137): n is a, c, g, or t
  misc_feature (201)..(201): n is a, c, g, or t
  misc_feature (218)..(218): n is a, c, g, or t
  misc_feature (247)..(247): n is a, c, g, or t
  misc_feature (255)..(255): n is a, c, g, or t
  misc_feature (302)..(302): n is a, c, g, or t
  misc_feature (313)..(313): n is a, c, g, or t
  misc_feature (356)..(356): n is a, c, g, or t
  misc_feature (388)..(388): n is a, c, g, or t
  misc_feature (529)..(529): n is a, c, g, or t
  misc_feature (532)..(532): n is a, c, g, or t
ttttttgngtataataaatccccagtctcctgttagccagctctatgtatattaaactgttctctattgcaatatccccgtcttgatnaatcagcattgtctgggcagcaggnaaaatgaagcaatttaggtgntangagagccaccgccatttggaacaggggcactctgaccattgactagagctgaagtgaacctgtnacagtaggtacctagtnaagcaagaacagtgctagggaggcccccngcccctcnccaggaatgtcaggcaatcatcaggtgatggtcagggagtttttttntgtttctctanaatagtgactggtcaccgccccaggtaaaaacagtcccctaancggtagaaagaacctgaaactggtgacgcacngcttcccaataatatctcaggagttgggcaagtcgtctcaagtatgtgcattaagaggtgaagtggtgaagtttaattgatatatgaccttccagggacatttccctggtaaggaaagaatacctcaagtgaacatgtgtnccnctccagtatacacactctgcatgctcccctcccaagtgctagcaggccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctca

SEQ ID NO: 370592 - DNA, 1937 bp, Homo sapiens
tgctaaaaccacatcagaatgccaagaggctgtgcatcttgttaatttttttcttgaactgttccagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcacgtgttgcttctgttttcctaaatactgtagggtcaactatataactaattgctttttattttaagagacggaatgctaaaaccacatcagaatgccaagaggctgtgcatcttgttaatttttttcttgaactgttccagggagttacatcataattacctgtgtgtgggtatgcatgggtggatgaaagatgctgttctcattccatcccaatagagtcttctgtttcctttctcttttttacatttatttttagcttttgcagtagtgtttagtgtgggttttactaattaatagaaaaagcactgggcctttaaacttcttaactactcttctctttcatctcctaaaacttttgagtattcattcttttctgaagtttgcatttaaatgaaaatgactttcgctttggcttttaggtttagtttcaaaaaggtttaattctgcaccctagccagttaagaaatgttttagcaggtatgcccttgatatggatatttatatattttacacatgtagtaatattatttctataacttactgttataaaacactaatttttaaatgatgagataaaaagaaatatctagaactagttctaacattgtcttcccctatgcatatggtaacgaaccattttacaccatactattttggagaccacaattttttttgcgtttgagatggagtctcactctgtggcccaggctggagtacagtggcatgatatcggctcactgtgacctctgtctcctgggttcaagcaattctcctgcctcagcctcctaagtagctgggattacaggcacctgcctccatacccagctaatttttttatatttttagtagagacagggtttcaccatgttggccaggctggagaccacaattttttaaccacagtgtagcaacactcaagtgggattgcgaatactgttactaatggttaatgtcacagcttgccttttctatattccagctgactaaaggtcatctcactcacttgccttctgatgtgttttcatgagttgaggggaaagggtgtcagtggcataacttcaggaagacccagggaaaagtgcttgggtaggtgaaactgtcatgtgtgccaagcttggaaaatagtttgagactcatggctgtaggcaccatccaaggccaattttccaattctggaaagccaaatctgaatcttagaatacctcacaagtgttaaaatgtgctttttagtgtctcctttatctcagtgtgtttatgatctgtcaacacataatcatcttttatacactacaaaaagggactcgggtgtctgaggggagagaatccctaggagcccaactctgatgttgctgtcagttacatcatctacagcagcacctcttagattgtgaaggatggtgtaacttaaaagattgtgtttctgcactgaagatagatacacagtgatagtgaagtttgttttccttatagtacttcattttgcatcttgattgctttttagggcctggggccaatgtcaacaactcttaggtagcaaaagaagaattagaacatgggcatcttttttatacctctttcagataaaagctatgatgttcacctgtaaaatatatggtttctctcttt

SEQ ID NO: 370593 - DNA, 508 bp, Homo sapiens
aatcaagtgttcccatgtgccaaggggaactgaggcattggaagaccggtcactacactttaattcatgaccatagcaaggctgaatttgccctagacttaattctgtactgtggctgtgaaggtaagagggaggaaagcaagcggtggattattccccgtaggaggggcagtctcttctgagggaccctttccagctgaaccaattcataagtaatttgcctagttcagaatctcacatcatgggatctcaaagtcaaagggattttacgggtcatgaattccagtctcccagctcaaaataggatttatatctgtgactaggaaatggggagatggaccacaccataattttcccctaagtgtgctcccagatctatagattttatgtaattgcccttctgggaatatttagcatttaattctctcttaattttcatattcaaagtttattgaaataagactgcatttcagttcagctgtctcaggaaattaggcatttaggggaa

SEQ ID NO: 370594 - DNA, 748 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaacaagtaatcatatttgttgggtgctaatatgtgccaggcagagtagtaagtgctttaaatgttacaacattgtgtatgtcatataaattcttgttgacattgttaacccactttgtagaggaggaaagagaccgagaaattgagtttgcatagcttaaaattcacgggagctagcatacaaacctaagtctgtctgattccaagggccaagttctcagtgataaaatgctcaatcttgttagtaatcaaggacacagaagttaacactgtagataccatttttcaccatgttcggttggttaata

SEQ ID NO: 370595 - DNA, 2842 bp, Homo sapiens
aacacgataaaggggacatgccgggagttgcagtaccctcaggaagaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctcaaaaaaaaaaaaaagtcgacgcggccgcgaat

SEQ ID NO: 370596 - DNA, 2345 bp, Homo sapiens
  misc_feature (2327)..(2327): n is a, c, g, or t
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacgaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaaccccccatacctcggagccctcacatcccacaagatcatgagattttgtatgattggatcaaccctacttatctggacatggattaccaagttcaaattcaagaagagtttgaagaaagttctgaaattctcctgaaggagtttcttaagcctgagaaattcacgaaagtctgtgaggccttggagcatggacatgtggaatggagcagccgaggtccccctaacaaaaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgggtagattgcgtgttntaagatcctgcagatcat

SEQ ID NO: 370597 - DNA, 2468 bp, Homo sapiens
aaagggcccaatgggccttggtttaaaatagagcttgtttacccaaaatttaaccgggatttttaccaaaatttaacgcttccattttccattgccattcagggtggccattgtttgaaaggccgatcgtggggcctttttgctaattccccaccttgcgaaaaggggattttcttccaagggatttaatttgggaaacccagggtttttccaggtccgacggttttaaaccacggcccattgatttttaaacggccccctttaaggggaatttgcccaattagccccaattttgggcgcattcataaagctgccccagtctaaaagtggatgggcccaagcgggccaaaaggtttttttttttttttttttttttttttttttttttttttttttttttttttttttttttttttttttttttttttttttttttttttttttttttttttctaacgatcagcttttattctgtgagtcattttacatctgtggctttgatgaacaacttgacattgctgtttttcaggttttatgagaaagctgaggagagtaagcttcctgagatattgaaggagtgcatgaagttatttcgctctgaggcactattcttgctgctctccaacttcacaggcctgaagcttcatttcttggccccttcggaagaagatgagatgaatgataaaaaagaggcagaaaccactgatatcactgaagaagggactagccatagtcctcctgagccagagaataatcagatggccatcagcaacaacagccaacagagcaatgagcagacagacccagagccagaggaaaatgaaacaaagaaagaatcaagtgttcccatgtgccaaggggaactgaggcattggaagaccggtcactacactttaattcatgaccatagcaaggctgaatttgccctagacttaattctgtactgtggctgtgaaggctgggagccagaatatggcggttttacttcttacattgccaaaggtgaagatgaagagctgctaacagtgaatccagaaagcaattctttggcattggtctacagagacagagagactctgaaatttgtcaagcatattaaccaccgaagcctggaacaaaagaaaaccttcccaaacagaacaggtttctgggacttttcattcatctattatgaatgacagcactgggcaaagctgaacaaaaatgtgacccttcgtaattactgggaagtctgaaagagctaagcatggagtcaaggagaactacatggtagcttgcctgacagtgttcttaaaactggttgtcttttactaggactcataatgattgtcctcaaccgagaccttgagcttgcagctacgtacttatctcttgattaaaaaaaaaaagttggcttttttttttttaacatttagtcctttttccatattggcttcttcagtgaatttttaagttcaatttgtttttattgaggtaaaatatttataacataaaactgaccagcttacccatttttaaatatgcaattcagtggattaagtacattctcattgttgtccagccatcaccatcatccatctccagaagttttccatcttcccaaattctgtgcccattgaacaataactccccacctccccttcccctagcaacagccatactttttgtctctatcatcaacttcactactcatatttctcatgtaagtggaatcatacagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaagaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctcaaaaaaaaaaaagaagaaaaaaacataagtgattgcagaattttgttcttctcataatttctggtttagaaaattatggagccttacatcctgatcatgctgggccttagaattctgacacagtgagtcatcacatttcctcccactgcctgtggccttgttccaccatgactctcacagtacagtgtaggcttagtgtagtattattcccttggaaagggtctggcctaccatcacatgccccaagaaacttctggttggtaaagaagataggctgcttattgccatgtgtagtcacttccaagtgcccactgcctttccatcctgcaattgtggcctgtgtataattaaatgattttagcctca

SEQ ID NO: 370598 - DNA, 841 bp, Homo sapiens
aacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaagtcattgtcatggacatggacccttttcttcactgtgtgatcccaaacttcatccaaagccaagacttcttagaagggcttcagaaggaactgatgaacttggacttccatgagaagtataatgatttatataagttccagcagtctgatgatttgaagaagagaagagagcctcacatctccactttaaggaaaattctgtttgaagatttccggtcctggctttctgatatttctaaaattgacctggaatcaaccattgacatgtcctgtgctaaatatgaattcactgatgccctgctgtgccatgatgatgagctggaagggcgccggattgccttcatcctgtacctggttcctccctgggacaggagcatgggtggtaccctggacctgtacagcattgatgaacactttcagccgaagcagattgtcaagtctcttatcccttcgtggaacaaactggttttctttgaagtatctcctgtgtcctttcaccaggtgtctgaagtgctgtctgaagaaaagtcacgtttgtctataagtggctggtttcatggtccatcattgactcggcctcccaactactttgaacccccactttgacctgttattaaagttcacattttgaaaaaaaaaaaa

SEQ ID NO: 370599 - DNA, 660 bp, Homo sapiens
cccagcggggtctggggaggggcaggcagggctgagccctgctgacctccccctgacctttcaaccctctctgattcccacaaaccctgctgacttgaccccattggcccagacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370600 - DNA, 240 bp, Homo sapiens
  misc_feature (19)..(19): n is a, c, g, or t
tgacacgcacgctcacgtnacacaagcctctagcaccaaggggagggacagtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370601 - DNA, 541 bp, Homo sapiens
cccagcggggtctggggaggggcaggcagggctgagccctgctgacctccccctgacctttcaaccctctctgattcccacaaaccctgctgacttgaccccattggcccagacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacagcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtc

SEQ ID NO: 370602 - DNA, 9520 bp, Homo sapiens
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaaggtatgtgtacccagaagggtccctgctggggtcctggtcgtgagatccctgagcttgatccgatgcctcttttcctcaaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccgggtacgtatgtcttactccacagccgaactcccttcatcccagctcttgcctctgatttccaacctctgagtcaatgaacctaatgtcaccatccagggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggcgattctctttggtccctcactgacctcctctgacctcacatggaccctctccctgctagggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370603 - DNA, 9189 bp, Homo sapiens
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaaggtatgtgtacccagaagggtccctgctggggtcctggtcgtgagatccctgagcttgatccgatgcctcttttcctcaaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccgggtacgtatgtcttactccacagccgaactcccttcatcccagctcttgcctctgatttccaacctctgagtcaatgaacctaatgtcaccatccagggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggcgattctctttggtccctcactgacctcctctgacctcacatggaccctctccctgctagggatccccaggaaaggatggagtgcctggtatccgaggagaaaaaggagatgttggcttcatgggtccccggggcctcaagggtgaacggggagtgaagggagcctgtggccttgatggagagaagggagacaaggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370604 - DNA, 7793 bp, Homo sapiens
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatgtgagtccggggcctaggcaagggcgagcctggcctgaggagtgtgatggcgggcataaggggccactcttgggccggggcacatgtctgagcccctgagtcgggctgcatgtcccaacatccaggagcctgctctctggatcacagggagccacacactgtcggcttccacactctgagctctgggggccctgtcttggcttctgtgtgcccatccttggtctgtttctcaccacatctgggcacacgtgtgctctggtctgatctcccagatcccaggacacacctgagttcttgtgaacctctccttggtcctgtgtttacaatcctcctttcccctgcccctggctgccagcgttcagcctgtggccatgcctgctctacccgggagtggacgtgttggggttcccctctgagcgcccgtgtgtccgcactcacgtctgtggagccagatgtctgcactcgcgtgtgggctccctgtgcctgtgccatgcctgaactcccacctgtctatggtagtatctgagcgtccctctgtctgtgctgtcctgagataggccatggtcatgtctgagctcctgtgagccaattcttggtcgcatgtctgagttc

SEQ ID NO: 370605 - DNA, 2262 bp, Homo sapiens
cctgggaatattttcagcccgtgtctgaactctgtgctcatgttcctaccctctcaaatgctgtttgctgggttttcttagggtcagaaaggggctccaggacccaaaggtttcaaggtatgtgtacccagaagggtccctgctggggtcctggtcgtgagatccctgagcttgatccgatgcctcttttcctcaaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370606 - DNA, 425 bp, Homo sapiens
tcctgcctgatcccctgatcccgcattcccagcggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtaggatgtcaggagtgataggtggtggctggggacttggctgggcaagataaagtgacctcttgccctgggcaggtgaacgtcccagctggtgagaccagtgtgcggctgcggggtctccggccactgaccgagtaccaagtgactgtgattgccctctacgccaacagcatcggggaggctgtgagcgggacagctcggaccagtgagcaattctgccagcctctga

SEQ ID NO: 370607 - DNA, 138 bp, Homo sapiens
ggggcacctggagttcgggggcctgtgggtgaaaagggagaccagggagatcctggagaggatggacgaaatgtgagtcccagcctatgactcctcaccccaaccttaaccctccaaccagccaattcccaatacctg

SEQ ID NO: 370608 - DNA, 275 bp, Homo sapiens
tggcctgggacctggccgctgagcatctgagtggccacacatgcagcggatgggccagtgttggggacagtcccactgaagggctcccccatctgtgtttctcacagggtcaacctggtgcagcagggatccctggtgacccggtaagatgcccctgctcccacaggggccccctgtccccagagggcccccgtcaccatggtggtcccaccagtgtggtagcttttgaccttatagtgacccagtgctctcatggtgtcctcatgtcacccagg

SEQ ID NO: 370609 - DNA, 592 bp, Homo sapiens
ggagagatgggtcagccaggccctagtggagagcgggtgaggggctgggaacagcatgtaggggcatggtgaatccatggtgggtgaggagggggccctgccttgggggttcccagtcttgagggggcagagggtaggagggttcccaagtcactctctgcctctcttgccccatttttctggtagggtctggcaggccccccagggagagaaggaatcccaggacccctggggccacctggaccaccggggtcagtggtgagtagaggtgccctaaagccccacgtatttgatttcctgtcctcgtgaggacttaggatggggcgggccacactgtggggtgttgggggaggcgctttgagagccacaggaccctcacctcactctgacctacagggaccacctggggcctctggactcaaaggagacaaggtaggtgggacaagtgctgctgactctctcttgtgccctggtcacccccttcagcctccactgacctcccatgaccctgcgtcccccactgattcccctcactgatccccggtgtcctgttggtctccagggagaccctggagtagggctgcctgggccc

SEQ ID NO: 370610 - DNA, 9281 bp, Homo sapiens
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370611 - DNA, 8223 bp, Homo sapiens
gcaacaccaggactcgggctggaggggcgctgggctcggacctgccaaggccaccgcaggggggagcaagggacagaggcgggggtcctagctgacggcttttactgcctaggatgacgctgcggcttctggtggccgcgctctgcgccgggatcctggcagaggcgccccgagtgcgagcccagcacagggagagagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtctgcatcctgatcacagacgggaagtcccaggacctggtggacacagctgcccaaaggctgaaggggcagggggtcaagctatttgctgtggggatcaagaatgctgaccctgaggagctgaagcgagttgcctcacagccaacctccgacttcttcttcttcgtcaatgacttcagcatcttgaggacactactgcccctcgtttcccggagagtgtgcacgactgctggtggcgtgcctgtgacccgacctccggatgactcgacctctgctccacgagacctggtgctgtctgagccaagcagccaatccttgagagtacagtggacagcggccagtggccctgtgactggctacaaggtccagtacactcctctgacggggctgggacagccactgccgagtgagcggcaggaggtgaacgtcccagctggtgagaccagtgtgcggctgcggggtctccggccactgaccgagtaccaagtgactgtgattgccctctacgccaacagcatcggggaggctgtgagcgggacagctcggaccactgccctagaagggccggaactgaccatccagaataccacagcccacagcctcctggtggcctggcggagtgtgccaggtgccactggctaccgtgtgacatggcgggtcctcagtggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactgacgcttctgttgagcagaccctgcgcccggtcatcctgggccccacatccatcctcctttcctggaacttggtgcctgaggcccgtggctaccggttggaatggcggcgtgagactggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggaccagagctgcctgtgagccctgtaacagacctgcaagccaccgagctgcccgggcagcgggtgcgagtgtcctggagcccagtccctggtgccacccagtaccgcatcattgtgcgcagcacccagggggttgagcggaccctggtgcttcctgggagtcagacagcattcgacttggatgacgttcaggctgggcttagctacactgtgcgggtgtctgctcgagtgggtccccgtgagggcagtgccagtgtcctcactgtccgccgggagccggaaactccacttgctgttccagggctgcgggttgtggtgtcagatgcaacgcgagtgagggtggcctggggacccgtccctggagccagtggatttcggattagctggagcacaggcagtggtccggagtccagccagacactgcccccagactctactgccacagacatcacagggctgcagcctggaaccacctaccaggtggctgtgtcggtactgcgaggcagagaggagggccctgctgcagtcatcgtggctcgaacggacccactgggcccagtgaggacggtccatgtgactcaggccagcagctcatctgtcaccattacctggaccagggttcctggcgccacaggatacagggtttcctggcactcagcccacggcccagagaaatcccagttggtttctggggaggccacggtggctgagctggatggactggagccagatactgagtatacggtgcatgtgagggcccatgtggctggcgtggatgggccccctgcctctgtggttgtgaggactgcccctgagcctgtgggtcgtgtgtcgaggctgcagatcctcaatgcttccagcgacgttctacggatcacctgggtaggggtcactggagccacagcttacagactggcctggggccggagtgaaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgccgcctgaggctccgccagccctggggacgcttcacgtggtgcagcgcggggagcactcgctgaggctgcgctgggagccggtgcccagagcgcagggcttccttctgcactggcaacctgagggtggccaggaacagtcccgggtcctggggcccgagctcagcagctatcacctggacgggctggagccagcgacacagtaccgcgtgaggctgagtgtcctagggccggctggagaagggccctctgcagaggtgactgcgcgcactgagtcacctcgtgttccaagcattgaactacgtgtggtggacacctcgatcgactcggtgactttggcctggactccagtgtccagggcatccagctacatcctatcctggcggccactcagaggccctggccaggaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggttggcctgctgtcttacagtcatcggccctccccactgttcccactgaatggctcccatgaccttggcattatcttgcaaaggatccgtgacatgccctacatggacccaagtgggaacaacctgggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctgggcttaatgtggtgatgttgggaatggctggagcggacccagagcagctgcgtcgcttggcgccgggtatggactctgtccagaccttcttcgccgtggatgatgggccaagcctggaccaggcagtcagtggtctggccacagccctgtgtcaggcatccttcactactcagccccggccagagccctgcccagtgtattgtccaaagggccagaagggggaacctggagagatgggcctgagaggacaagttgggcctcctggcgaccctggcctcccgggcaggaccggtgctcccggcccccaggggccccctggaagtgccactgccaagggcgagaggggcttccctggagcagatgggcgtccaggcagccctggccgcgccgggaatcctgggacccctggagcccctggcctaaagggctctccagggttgcctggccctcgtggggacccgggagagcgaggacctcgaggcccaaagggggagccgggggctcccggacaagtcatcggaggtgaaggacctgggcttcctgggcggaaaggggaccctggaccatcgggcccccctggacctcgtggaccactgggggacccaggaccccgtggccccccagggcttcctggaacagccatgaagggtgacaaaggcgatcgtggggagcggggtccccctggaccaggtgaaggtggcattgctcctggggagcctgggctgccgggtcttcccggaagccctggaccccaaggccccgttggcccccctggaaagaaaggagaaaaaggtgactctgaggatggagctccaggcctcccaggacaacctgggtctccgggtgagcagggcccacggggacctcctggagctattggccccaaaggtgaccggggctttccagggcccctgggtgaggctggagagaagggcgaacgtggacccccaggcccagcgggatcccgggggctgccaggggttgctggacgtcctggagccaagggtcctgaagggccaccaggacccactggccgccaaggagagaagggggagcctggtcgccctggggaccctgcagtggtgggacctgctgttgctggacccaaaggagaaaagggagatgtggggcccgctgggcccagaggagctaccggagtccaaggggaacggggcccacccggcttggttcttcctggagaccctggccccaagggagaccctggagaccggggtcccattggccttactggcagagcaggacccccaggtgactcagggcctcctggagagaagggagaccctgggcggcctggccccccaggacctgttggcccccgaggacgagatggtgaagttggagagaaaggtgacgagggtcctccgggtgacccgggtttgcctggaaaagcaggcgagcgtggccttcggggggcacctggagttcgggggcctgtgggtgaaaagggagaccagggagatcctggagaggatggacgaaatggcagccctggatcatctggacccaagggtgaccgtggggagccgggtcccccaggacccccgggacggctggtagacacaggacctggagccagagagaagggagagcctggggaccgcggacaagagggtcctcgagggcccaagggtgatcctggcctccctggagcccctggggaaaggggcattgaagggtttcggggacccccaggcccacagggggacccaggtgtccgaggcccagcaggagaaaagggtgaccggggtccccctgggctggatggccggagcggactggatgggaaaccaggagccgctgggccctctgggccgaatggtgctgcaggcaaagctggggacccagggagagacgggcttccaggcctccgtggagaacaaggcctccctggcccctctggtccccctggattaccgggaaagccaggcgaggatgggaaacctggcctgaatggaaaaaacggagaacctggggaccctggagaagacgggaggaagggagagaaaggagattcaggcgcctctgggagagaaggtcgtgatggccccaagggtgagcgtggagctcctggtatccttggaccccaggggcctccaggcctcccagggccagtgggccctcctggccagggttttcctggtgtcccaggaggcacgggccccaagggtgaccgtggggagactggatccaaaggggagcagggcctccctggagagcgtggcctgcgaggagagcctggaagtgtgccgaatgtggatcggttgctggaaactgctggcatcaaggcatctgccctgcgggagatcgtggagacctgggatgagagctctggtagcttcctgcctgtgcccgaacggcgtcgaggccccaagggggactcaggcgaacagggccccccaggcaaggagggccccatcggctttcctggagaacgcgggctgaagggcgaccgtggagaccctggccctcaggggccacctggtctggcccttggggagaggggcccccccgggccttccggccttgccggggagcctggaaagcctggtattcccgggctcccaggcagggctgggggtgtgggagaggcaggaaggccaggagagaggggagaacggggagagaaaggagaacgtggagaacagggcagagatggccctcctggactccctggaacccctgggccccccggaccccctggccccaaggtgtctgtggatgagccaggtcctggactctctggagaacagggaccccctggactcaagggtgctaagggggagccgggcagcaatggtgaccaaggtcccaaaggagacaggggtgtgccaggcatcaaaggagaccggggagagcctggaccgaggggtcaggacggcaacccgggtctaccaggagagcgtggtatggctgggcctgaagggaagccgggtctgcagggtccaagaggcccccctggcccagtgggtggtcatggagaccctggaccacctggtgccccgggtcttgctggccctgcaggaccccaaggaccttctggcctgaagggggagcctggagagacaggacctccaggacggggcctgactggacctactggagctgtgggacttcctggaccccccggcccttcaggccttgtgggtccacaggggtctccaggtttgcctggacaagtgggggagacagggaagccgggagccccaggtcgagatggtgccagtggaaaagatggagacagagggagccctggtgtgccagggtcaccaggtctgcctggccctgtcggacctaaaggagaacctggccccacgggggcccctggacaggctgtggtcgggctccctggagcaaagggagagaagggagcccctggaggccttgctggagacctggtgggtgagccgggagccaaaggtgaccgaggactgccagggccgcgaggcgagaagggtgaagctggccgtgcaggggagcccggagaccctggggaagatggtcagaaaggggctccaggacccaaaggtttcaaggtatgtgtacccagaagggtccctgctggggtcctggtcgtgagatccctgagcttgatccgatgcctcttttcctcaaagggtgacccaggagtcggggtcccgggctcccctgggcctcctggccctccaggtgtgaagggagatctgggcctccctggcctgcccggtgctcctggtgttgttgggttcccgggtcagacaggccctcgaggagagatgggtcagccaggccctagtggagagcggggtctggcaggccccccagggagagaaggaatcccaggacccctggggccacctggaccaccggggtcagtgggaccacctggggcctctggactcaaaggagacaagggagaccctggagtagggctgcctgggccccgaggcgagcgtggggagccaggcatccggggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaaggacacagggaagaagctggatccccaggcggccccggggctgcaaggaccacacaggagacgatggggaacgcactgatgtgcgggcaagcgggggaccc

SEQ ID NO: 370612 - DNA, 1991 bp, Homo sapiens
ctctctcttgtgccctggtcacccccttcagcctccactgacctcccatgaccctgcgtcccccactgattcccctcactgatccccggtgtcctgttggtctccagggagaccctggagtagggctgcctgggccccgaggcgagcgtggggagccaggcatccgggtacgtatgtcttactccacagccgaactcccttcatcccagctcttgcctctgatttccaacctctgagtcaatgaacctaatgtcaccatccagggtgaagatggccgccccggccaggagggaccccgaggactcacggggccccctggcagcaggggagagcgtggggagaagggtgatgttgggagtgcaggactaaagggtgacaagggagactcagctgtgatcctggggcctccaggcccacggggtgccaagggggacatgggtgaacgagggcctcggggcttggatggtgacaaaggacctcggggagacaatggggaccctggtgacaagggcagcaagggagagcctggtgacaagggctcagccgggttgccaggactgcgtggactcctgggaccccagggtcaacctggtgcagcagggatccctggtgacccgggatccccaggaaaggatggagtgcctggtatccgaggagaaaaaggagatgttggcttcatgggtccccggggcctcaagggtgaacggggagtgaagggagcctgtggccttgatggagagaagggagacaagggagaagctggtcccccaggccgccccgggctggcaggacacaaaggagagatgggggagcctggtgtgccgggccagtcgggggcccctggcaaggagggcctgatcggtcccaagggtgaccgaggctttgacgggcagccaggccccaagggtgaccagggcgagaaaggggagcggggaaccccaggaattgggggcttcccaggccccagtggaaatgatggctctgctggtcccccagggccacctggcagtgttggtcccagaggccccgaaggacttcagggccagaagggtgagcgaggtccccccggagagagagtggtgggggctcctggggtccctggagctcctggcgagagaggggagcaggggcggccagggcctgccggtcctcgaggcgagaagggagaagctgcactgacggaggatgacatccggggctttgtgcgccaagagatgagtcagcactgtgcctgccagggccagttcatcgcatctggatcacgacccctccctagttatgctgcagacactgccggctcccagctccatgctgtgcctgtgctccgcgtctctcatgcagaggaggaagagcgggtaccccctgaggatgatgagtactctgaatactccgagtattctgtggaggagtaccaggaccctgaagctccttgggatagtgatgacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtactgcccaggactgaggcccagataatgagctgagattcagcatcccctggaggagtcggggtctcagcagaaccccactgtccctccccttggtgctagaggcttgtgtgcacgtgagcgtgcgtgtgcacgtccgttatttcagtgacttggtcccgtgggtctagccttcccccctgtggacaaacccccattgtggctcctgccaccctggcagatgactcactgtgggggggtggctgtgggcagtgagcggatgtgactggcgtctgacccgccccttgacccaagcctgtgatgacatggtgctgattctggggggcattaaagctgctgttttaaaaggc

SEQ ID NO: 370613 - DNA, 300 bp, Homo sapiens
taagcctaaagtaatgaatgtctgaagttccagaaatcacaatggtataaataaagaagaagtgtgactacatttccaagtaggaagtcttgatatgacagaaaagtattaaaatatagggtatatatgggatatatgagacattttctgaaagattcataggactttgtaaattagttgtctgacttcatttttaactggatagctagaaagaatgatatcaaggatatgatagatcattttctctggtctttatgtgtgtctttatgctgatgatgatagactttaaggagtctatct

SEQ ID NO: 370614 - DNA, 444 bp, Homo sapiens
gcacacatggtggccccattggttgagggtgtgaggttgctggtggctgcagattctaggtggctggctttcaggccctggagagtgcatgctttggttttcccagtcctgggtgtggtcccccactgcactgactgcctggttccatggggtgtagggagctaagtaggcttgggtgttgagatcatgactctaacactgggtctatctggagtcatgacactgcagccctttgtttgggcatggtggggtgaaaaggggatccagggatgtgaagatgcaggggctattgggttccagggcaggatgcgctttagcagtagctctgtttgcaaagtggtgacaggctgcagcagcttgggtcctggggatttggggagatccagcatgaatttcctctctggagcaatgcagctatatggactccaagcagctcgctatatt

SEQ ID NO: 370615 - DNA, 3646 bp, Homo sapiens
gtcttctcagccgggacgccagcggttctgattacagacctcggctgcccgacaactacacgcaggacacgtggcggaagctgcacgaggcggtgcgggccgtgcagagcagcacctccatcaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370616 - DNA, 697 bp, Homo sapiens
  misc_feature (1)..(1): n is a, c, g, or t
  misc_feature (44)..(44): n is a, c, g, or t
nttctagccggccgatcccccggccttcagaattcggcacgagnacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttc

SEQ ID NO: 370617 - DNA, 406 bp, Homo sapiens
ggatccgctccaacatcagaatggtaacacaaacacactagccccaaaccctaaaacagagattcacaaggaactcagctgacgaacagacgcagcagggcgtacaccatggccttggcacctcagggagctcacttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggta

SEQ ID NO: 370618 - DNA, 1536 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcacagcacgactcttttctgcttctagaccagcaggagaatctgcctgtctgacctgctgagatagggccttatatgatgtaacccgtaacccagtcaaggaatgatgaccttcgtattcacagcctcgttcacagttgcgtgtgaggcatcctccacgtggggacagggcaggagc

SEQ ID NO: 370619 - DNA, 838 bp, Homo sapiens
agaggcggcctgattcgcgtcgacaaacgcgccatcgctccctcacattccccgtctcacatcgccacttcctactttgtgagcagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacccataccgcatgttccttcatagatgtgtcctccaactaggccctgctcttgtgtgactaccgttgcctttttgtgctcgctgttctgtgtgatcatctactgcacgtcgtcattacgaccctatatgctgcttttgccatactgtgaggacaccttaagaagtccctaattaccgcttcctacaaaggaccgaccatgatattgcatacacaggccctacctggtcggaacttttcaccgattcgccttttgttattctccatcgggtcgaatttcgcttgcccactgtctcgccgtgcgcccacagatgagcaaaacgcgcgatcgcgcgacgatgattgttatgaaacacggatatacgtaagcaccggaagactctgtcgtgcgtatgctcgattgtttcccttgaata

SEQ ID NO: 370620 - DNA, 407 bp, Homo sapiens
ccagggaagtccgggggaaatagtggagagagcggcagccacagcgaagccccacaaccagggtgtgcaggtcacacacagcttccctgagccctttctgcctgtgtaggaagcagaaggcggaatgtcggctctgcccttctccgtaagatggtgcattaaaacgttccttataaactggaaatgaaggcttgggaagatggctaaaatcagcaatccttggaataacgcagaagcatccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagac

SEQ ID NO: 370621 - DNA, 520 bp, Homo sapiens
agggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgtgccgtcgtgcctccgggatcctctgga

SEQ ID NO: 370622 - DNA, 3779 bp, Homo sapiens
cccgcccgacttggggggaaggccccgagatccgtgcgggccccgggagcgggggcgccggggcgccggccgggtcgggggtggctacgcggggcgcttcgcggcgcgccctgagccgcccgctctccctccgccctgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370623 - DNA, 3756 bp, Homo sapiens
acattaactgttgttacctctacccccatgccaactatgactggactgcagtgttccaacgagaagtgccctaaacttagccataataagtaatttatttgtagattcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370624 - DNA, 4410 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370625 - DNA, 4393 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcaggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370626 - DNA, 4312 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370627 - DNA, 3114 bp, Homo sapiens
  misc_feature (18)..(18): n is a, c, g, or t
  misc_feature (30)..(30): n is a, c, g, or t
gggtcagcttgtaatgangtgcccagagtnacctctcgcgagttttttacatagtcatgaggggcgggcgttagtttgatttgactggccgtcgttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370628 - DNA, 2103 bp, Homo sapiens
  misc_feature (51)..(51): n is a, c, g, or t
  misc_feature (61)..(62): n is a, c, g, or t
  misc_feature (65)..(65): n is a, c, g, or t
cagcggtccgtcatacagaggcgtggtaactactttgggacatgctgtgtnaaagcggagnntanagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370629 - DNA, 2017 bp, Homo sapiens
tccccgtctgtcttctgaatcctttcctttgggacttttatcagcacacgtgctttgccacaggccaggactgcagcgttctgcgcaattcactatcctctatccccgtggccatttttatctcctcaaagctgaagccatctccctcgttgaacatgaggagcaccagtgtctggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370630 - DNA, 2353 bp, Homo sapiens
gcagttttcattttgatttctgattctttacagcatctttctaccactcagtagtttatacaaattatataatctttctaatgctcagtttctcatatttaaaatagacatactactacctcaagttgtgagaattaaatgaatcgtttagaaagctctttgccacacacctgtaagcacttcatacatgttgatgctgctctttttatgcttagccatttgtatttttctttttctaattgcttttcaagtcatatgcattcattataatgttttttctcttactgattagtaggttttctttatatattaaggatattaatgctttgtccctttttttttttcgtttttttttttttttttttttttgcatttcactctgtcgtccaggctggagtgcagtggtacaatctcgctcactgcaacctccgtctcgggaggctgaggcaagagaatcgcttgatcctgggaggcggaggttgcagtgagccgagatcacaccattgcactctagcccaggcaactgagtgagactccatcgcaaaaaataaaaagaaaatacagttttacacttaactttttttttcttttttatacagttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370631 - DNA, 3244 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaaaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttcacattctcagtaggaaagaaaatcagaaaaaaagccacttaatgttattcctattcacaaaaaagttgtgtgctaagccagaactccccatggtcatagggtttcgaaaattatccacactttctatggtaatagaatctgatatggttcactcttggtgttgtacattctgtgggtctgggtaaatgtataatgttatgtatccaccattataggatcatacaggacagtttcattgccctaaaaattctcttatgttctgtcgctgtatccctgtctccctccgagcccctggcaacccctgaccctgttactgtcaccatagttttgccctttcctgaatgccgtacagttggagtcatagtgtatatagccttttcagattggcttctttatttattagaacgtatttgaggttcaccgtgtcttttcatgactgggtaactctgctttttgcactgaaggattctc

SEQ ID NO: 370632 - DNA, 2871 bp, Homo sapiens
  misc_feature (2812)..(2812): n is a, c, g, or t
  misc_feature (2840)..(2840): n is a, c, g, or t
  misc_feature (2859)..(2859): n is a, c, g, or t
  misc_feature (2869)..(2869): n is a, c, g, or t
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagtaagtaccgtttgttcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcacgcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttgggccttcaggtccacagtcacagtccgcagtgggtgacagggttcttaggatgcctgcatggggtctctaaatgtctcttttaaggcacagtttacttcctcaggaatctaggcctggattcccggggtnttttcctgcagcttgcacaaccagcgtnttaagggttttttaaggantctttgggcntt

SEQ ID NO: 370633 - DNA, 2458 bp, Homo sapiens
  misc_feature (782)..(782): n is a, c, g, or t
  misc_feature (867)..(867): n is a, c, g, or t
  misc_feature (2399)..(2399): n is a, c, g, or t
  misc_feature (2427)..(2427): n is a, c, g, or t
  misc_feature (2446)..(2446): n is a, c, g, or t
  misc_feature (2456)..(2456): n is a, c, g, or t
gatgagcacctaggaggactttcctcatgtttgccttttcacacacatgcaaatgtttcattgaaaatcttctgaaagccgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacacgtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcncagggacgaaagagaagtgcagcctgggccctgttgtaggatggatgttaatatcagcgtcctttctccatgtcccccacacacntttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagtaagtaccgtttgttcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcacgcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttgggccttcaggtccacagtcacagtccgcagtgggtgacagggttcttaggatgcctgcatggggtctctaaatgtctcttttaaggcacagtttacttcctcaggaatctaggcctggattcccggggtnttttcctgcagcttgcacaaccagcgtnttaagggttttttaaggantctttgggcntt

SEQ ID NO: 370634 - DNA, 1763 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttc

SEQ ID NO: 370635 - DNA, 1777 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctttgttctctgttaatgtagtgtttcattcttctcacattcatacataaaagtgatgtcgtgccttctcatgagctttaaacccaagttctttaaaatgtgcctgcttttcctaccccaccctctgggcccg

SEQ ID NO: 370636 - DNA, 1105 bp, Homo sapiens
acattaactgttgttacctctacccccatgccaactatgactggactgcagtgttccaacgagaagtgccctaaacttagccataataagtaatttatttgtagattcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaatatcctttttttggttcataaagtttctattcattatctaagtcttttaaaactgaacattattatgataaagagctaatgagtatccttaatattaaaacaacagcttttaaagttctcttttatttgataggtttgtaagcgaaatttaccatttaaattattttgctgatttgaattaaagggaaaccgtgttcatttattgggtatggttgaagtatttaggaaatgttctgaaaaatgtcttcaagtttgagtatcctttattctaataaacaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcacagcacgactcttttctgcttctagaccagcaggagaatctgcctgtctgacctgctgagatagggccttatatgatgtaacccgtaacccagtcaaggaatgatgaccttcgtattcacagcctcgttcacagttgcgtgtgaggcatcctccacgtggggacagggcaggagc

SEQ ID NO: 370637 - DNA, 1314 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagatcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttc

SEQ ID NO: 370638 - DNA, 381 bp, Homo sapiens
ggagctggagcggacgttggacaagatcatgatcctgttcaggtttatccacggtgagactcgggcactcagaaaatgctgcataatcaagaggtgtaaacaggccctgctttcccagaggaggtttagcatgagaatgtcagtatcagtagagccagtttgcattagaatgaacacttttcatccttgctaacatggtgaaaccccgtctctactaaaaatacaaaacattagccaggcgtggtggcaggcgcctgtagtcccacctacttgggaggctgaggcagagaatggcgtgaacgcgggaggcggagcttgcagtgagccgagatcgcgccactgcactccagcctgggcaacagagcaagactctgtctcaaa

SEQ ID NO: 370639 - DNA, 340 bp, Homo sapiens
atccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagacaaatgcccccatcttttgcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgca

SEQ ID NO: 370640 - DNA, 3920 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggta

SEQ ID NO: 370641 - DNA, 3684 bp, Homo sapiens
ggtccgtctgggtcctggcgcccccggccccgccgcgggtgcgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370642 - DNA, 4405 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370643 - DNA, 2771 bp, Homo sapiens
  misc_feature (2)..(2): n is a, c, g, or t
  misc_feature (8)..(10): n is a, c, g, or t
  misc_feature (14)..(15): n is a, c, g, or t
  misc_feature (18)..(19): n is a, c, g, or t
gnattgannngctnntgnngacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370644 - DNA, 4362 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagcttgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370645 - DNA, 4052 bp, Homo sapiens
  misc_feature (782)..(782): n is a, c, g, or t
  misc_feature (867)..(867): n is a, c, g, or t
gatgagcacctaggaggactttcctcatgtttgccttttcacacacatgcaaatgtttcattgaaaatcttctgaaagccgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacacgtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcncagggacgaaagagaagtgcagcctgggccctgttgtaggatggatgttaatatcagcgtcctttctccatgtcccccacacacntttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370646 - DNA, 3119 bp, Homo sapiens
agggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgttgctaatagaaattgaagatgctctctttttctagtttagagtatttactatatgtttatgctcacagcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370647 - DNA, 3065 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagataaaaatggccacggggatagaggatagtgaattgcgcagaacgctgcagtccctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaaaaaaaaattcttca

SEQ ID NO: 370648 - DNA, 3350 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttcacattctcagtaggaaagaaaatcagaaaaaaagccacttaatgttattcctattcacaaaaaagttgtgtgctaagccagaactccccatggtcatagggtttcgaaaattatccacactttctatggtaatagaatctgatatggttcactcttggtgttgtacattctgtgggtctgggtaaatgtataatgttatgtatccaccattataggatcatacaggacagtttcattgccctaaaaattctcttatgttctgtcgctgtatccctgtctccctccgagcccctggcaacccctgaccctgttactgtcaccatagttttgccctttcctgaatgccgtacagttggagtcatagtgtatatagccttttcagattggcttctttatttattagaacgtatttgaggttcaccgtgtcttttcatgactgggtaactctgctttttgcactgaaggattctc

SEQ ID NO: 370649 - DNA, 2573 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagtaagtaccgtttgttcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcacgcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaactggacccagtagggaatgataaaatgtacagatgtgcagaacaggacttggtaggactcagcagagaaaacaggaggagagatgaaaatgatatggtgtgcagaactggactcagtaaggtgcggaaaggggaaggattctgacagaatccagcacaaaaacagagagggtgcagaaaaaga

SEQ ID NO: 370650 - DNA, 1077 bp, Homo sapiens
cccgcccgacttggggggaaggccccgagatccgtgcgggccccgggagcgggggcgccggggcgccggccgggtcgggggtggctacgcggggcgcttcgcggcgcgccctgagccgcccgctctccctccgccctgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttc

SEQ ID NO: 370651 - DNA, 1828 bp, Homo sapiens
ctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccaccctctgggcccg

SEQ ID NO: 370652 - DNA, 441 bp, Homo sapiens
atactgtttcatcaacaagggtgcaacatggatagcataagtcattagcataatccaaatgcttgctaacggcctttggaatgcctaaacttaaaaaagtacactaccaaggacttggaaagaatctcgcactccaacgccaaagaatctattgcatattaatcttcattagaaaaaaaattgattggggacctaaagacaaaaataagcctattgtgcaatagcaaaacattaaaaaaatttaaaaagctttaggaaatttcatgtcattgtacaaagatgctacaccggagaaagggggatctggtgatcctaattttgtcaccagctttgaaatctttagctaggcatttcagccctataaaaatccattttctcacttgtaaaaagaagagttgaagttatgtttttccagggcttttttctctgacaaaccgaatt

SEQ ID NO: 370653 - DNA, 469 bp, Homo sapiens
cctactctctcttccgtagggtggagttgcagctggtaaatggctcccagcagggagcttgccaggctccttgacacctgtgtgaagccatgcgactcattctgcaaatgaaagcaagcagaaaggatgcgggtcacttcttgatcaaggtggttaacagaggggcatatcttctccagagtctctcaatcctggcactagctggatggcaaagcccagggcaatcttagagacctggcggtaaagatgacaaaccctctctcagctttgggtcctgaatgggttcccaaatgtgaaatagggtctgctacataagacagaaacagacttcttttgtgttaaactgctgaaattgcagagttatttgttacagcaactaatgttaccctaattaacacaaacctaacaagaaatgtccaggatttacatgaaaaaacttctaaatgtttagaagactatatgagatttg

SEQ ID NO: 370654 - DNA, 234 bp, Homo sapiens
acctgttgaatgtcaggcagtgtgttggacagtgagatgtgaatacaaaacagcctctgtagaaagggatgtcacaatctagtgtcatccaaacaagatgataaaagtagatgaggccgggcacagcagctcacacctgtaatcccagcactttgggaggctcaggcaggcagatcgcttgagcctaggagtttgagaccgacttcagcaacctgataaaaaaaccctctatac

SEQ ID NO: 370655 - DNA, 951 bp, Homo sapiens
gtggtcatcccgcctcagccacctactacaggaccgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaaggtggtggcctgtttggattcaggcccaggggccgagacattcccttcttcactcttttcc

SEQ ID NO: 370656 - DNA, 253 bp, Homo sapiens
gggtgggtgttataaaagccagtctgtaaagggtaaattcccaatcttgtgccttgttatacccatccctccttggccacccaccacctctcgcacagcccctctgtttttacaccaataacaagaattaagggggaagccctggcagctatacgttttcaaccagactcctttgccgggacccagcccgccaccctgctcgcctccgtcaatggcctgagatcgtcctgcctgaatgggatcctctagatca

SEQ ID NO: 370657 - DNA, 857 bp, Homo sapiens
attttaatagaatttacatggacaccttggttttagtgttagataaaagcaacatatctttcctggcaataggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtggtatgtttctacagtgagccatcagaatttctagtgccaataaagcttctttggacctttggggcatgaaactgagtataagtaaatttaaaaatgaattgtattatatttagaaatgtcacgtggctttagatacctaaaaatgtatgagttattttagctttgtgtttcagaagaagggttgtgatagggaagataatgtcttaaaatagttcttttatttggctttcatctcagttttctgaaaattatttttatattaagaggaagcactaagaaactgttgatgtgggaaatgctaatatgaaattaattggttctccctccccttttgagatcagatctgaataatgtgcctttctttataaggtcttcatttgtagatagatgcctgttaattttatgattttaagtatgtataggaaatgattatttattatctcatgatctatatttgcgattctgttgtttatttttatttatttatttatttatttgagatggagtctcgctctgttaccaagaggatataaaatgagccaagttagcacaaaatacacatcaagccaggctgaaaaaatgagctctgactcaaaaaaaaaaaccaccca

SEQ ID NO: 370658 - DNA, 1505 bp, Homo sapiens
gcatcccgggactgaacccctcctccctttcacagattacctcatccgagcaagattcctccctccctccctcctagagacctgatcccgccacatccccgcctccctctctgggcagatgtgttactcctagggcagttttcctctcgggcgtctctcgggtgatggcctcatccagggccacgttctcctggcccttggggatcgtgtcccttccagcaccttgctttcgaaaacccgatgaaccctcgcgccatccccgggccaggtccctatactgccagccactcccccttccttcacctccaccctctacccccaccccaagcagaccgatcctcccccatcccgcccttctcttctcgtcatttcattattgatccaccttttcctaggccaatcctggggcttggaaggggtgggggaagccaggttggggtgaggagagtagataagggacagttatactttagtgtggtggcggtggttgctttgggatgggagaaaaaggattatcaagcaaagttattccttagaaaggacttggggttgtctctgattcttgtaaggggacccaaggtggatgaagggtcagagcgttgccccttccccattagtactggggcaagaacggagttgcttctataaacattattcggcccccttcagcaaaaaggaaagttgcccaaggaagggaagttgagttcaggttcagccagtggcgttgcgcatttgttttccattggatgcagaaggggggagttcgaattgtagaggggggaggatggcatgggggatgctaggaggaggaagagcagctgctaggggctgaagcgaaggggggtagggggttgctgctctggagtgctcttgattgaaacagaaagggaaagataacaaccagccgtttcctgcgtgctctgccgttggtgcacacaaaatatcctgggcaaaccccttgtcccctattgtgccccgcacccctttagatttacggaaagatcctgggaagaaggggagggaggagatcccaaggaccctggcccctcctttcaaggagctggcattttttagttgttagtcttcctgcctcctttttttttaatcgtttctaaggcagcctgatcaggagactgacaacaacccgccttctgacagagcaaggaggacatgatgggggcgtgttccttgctatgtagctagctgcagcgtcccctttccctgcctctttctgctctatctccacctccttttcccagccttcagaaggcagctgcagtcagcagggttgtttgagactatttattggttgctgtagattattatttttttttgaaaggccaattctgtattttttaagctaacaacacagatcccatgtagttggagaaccaaaggccacatacatgacaaaaagactgaaccgttcaggttacttgcatggagttggtgcttaaatgtgagttgattttgcttttttaaaagatacagcagcaaaaaaaaaa

SEQ ID NO: 370659 - DNA, 17017 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370660 - DNA, 16964 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagatcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370661 - DNA, 15389 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaagtccccgcctccttgcctctgggcgacccattgatgatcatagatgagtgtccagcgaaaaaaaaagcgttatcttt

SEQ ID NO: 370662 - DNA, 17764 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcaggtatgtgggtgggtaaaaggttagaatcagagaatatcaatgctaaaaggattatgagaatcacccactttacctacttattttctacatttaaaaaaaaaaatctaagctccaaagaagttaagtgatttggcccacattggactgaaacttggcgcacctgtctctcggtgcagtgttcttccagtacatattgtgtgatcacctgtcagctaaggactcaagaccatacccatactcttctgctgtactggttttaccagcactgaggcttaaatagctagtaataacctgacttcactttttagttgttactaaagaaaactaagaaccatttttattagatagtcagattttggttacaataccagatacatctccatggcattttccatcagttctaatgaatttgattaggaaacaaatggtcacttcaagattagagagttctgggtataactctattgaggacagttgcttattgaaaaactatcagatcgtcatactagaaattctaccacagagagcataacttcatgtaaaaaaaaatctggttttagtcaccactttctagcaatgacctaggcaagctctttgagtcttgggtttgttatctataaatgggaataataaaccaactgtggaatgttgttaggcttagagatcatttatgtaaagtactctacatgtagtcagtgctcagtgagcatttgttactgcaaccactatctattttctccctattagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370663 - DNA, 16391 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370664 - DNA, 17116 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370665 - DNA, 16985 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370666 - DNA, 16636 bp, Homo sapiens
gtccagagcagagcaaacagaaaaaagtggctccccgcccaagtatccctgtaaaacaaaaaccaaaagaaaaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370667 - DNA, 14500 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcaggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370668 - DNA, 12263 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcaggtatgtgggtgggtaaaaggttagaatcagagaatatcaatgctaaaaggattatgagaatcacccactttacctacttattttctacatttaaaaaaaaaaatctaagctccaaagaagttaagtgatttggcccacattggactgaaacttggcgcacctgtctctcggtgcagtgttcttccagtacatattgtgtgatcacctgtcagctaaggactcaagaccatacccatactcttctgctgtactggttttaccagcactgaggcttaaatagctagtaataacctgacttcactttttagttgttactaaagaaaactaagaaccatttttattagatagtcagattttggttacaataccagatacatctccatggcattttccatcagttctaatgaatttgattaggaaacaaatggtcacttcaagattagagagttctgggtataactctattgaggacagttgcttattgaaaaactatcagatcgtcatactagaaattctaccacagagagcataacttcatgtaaaaaaaaatctggttttagtcaccactttctagcaatgacctaggcaagctctttgagtcttgggtttgttatctataaatgggaataataaaccaactgtggaatgttgttaggcttagagatcatttatgtaaagtactctacatgtagtcagtgctcagtgagcatttgttactgcaaccactatctattttctccctattagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtaatggctggaggtgttattccactcctgtctcagaatattatggtaaattgttcgcctaaggcagagttgattctgtgaaaaaaaaatcagttaaaaatttttttcacagctttattgagatttaattcatataccatacagttcacccatctaaagcatacaattcagtggtttttaatatattcagagttgtataaccaccactactctataattctagaacattctcatcatccctaaaagaaaccccctattcattagcagtcattcctcagcccctggccaccacaaatctactttctgtctctatgtatttgattattctggacatttcatataaatgaaatcagaca

SEQ ID NO: 370669 - DNA, 11005 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggtaagctgaagaattcgtcttttaagactaagctctcagttttgtccacctcatttaaaaaatagttcttccaggccgggcgcagtggctcacgcctgtaatcctagtagtctgggaggccgaggcaggtggatcacgaggttagatcgagaccat

SEQ ID NO: 370670 - DNA, 4293 bp, Homo sapiens
acccaactccagtgggccactcccctccttcccctattgaagctccacattaaacaacaaaaagtacaccttcgtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370671 - DNA, 5582 bp, Homo sapiens
  misc_feature (4696)..(4696): n is a, c, g, or t
  misc_feature (4705)..(4705): n is a, c, g, or t
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgncagagaagntggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagaagctggagtggtggcctgtttggattcaggcccaggggccgagacattcccttcttcactcttttcc

SEQ ID NO: 370672 - DNA, 6947 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagcagccagctgcgccaccagagggccccaggagcacagagcccccacggcggcacccagagagtaagggcagcagcgacagtgccacgagtcaggagcattctgaatccaaagatcctccccctaaaagctccagcaaagcccccgcgcccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcagcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggaaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaa

SEQ ID NO: 370673 - DNA, 4831 bp, Homo sapiens
  misc_feature (4551)..(4551): n is a, c, g, or t
  misc_feature (4582)..(4582): n is a, c, g, or t
  misc_feature (4627)..(4627): n is a, c, g, or t
  misc_feature (4680)..(4680): n is a, c, g, or t
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctncaacagtgaatggataccacgcatcagggancccagcgcaccctccagagactgcccacatgagtgtccgaaaatncaccggtgattcccagaacctgggatcctcatcgccaagcaaaaagcagagcnggaaaacaccatcacaataaactgtgtgacgttccctcacccagacacgatgccggaacagcagctgctgaaaccaaccgacgaagctggagtggtggcctgtttggattcaggcccaggggccgagacattcccttcttcactcttttcc

SEQ ID NO: 370674 - DNA, 4379 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagtttgtgtattgccaagtctgttgtgagcccttccacaagttttgtttagaggagaacgagcgccctctggaggaccaggtggtggcctgtttggattcaggcccaggggccgagacattcccttcttcactcttttcc

SEQ ID NO: 370675 - DNA, 4743 bp, Homo sapiens
  misc_feature (4551)..(4551): n is a, c, g, or t
  misc_feature (4582)..(4582): n is a, c, g, or t
  misc_feature (4627)..(4627): n is a, c, g, or t
  misc_feature (4680)..(4680): n is a, c, g, or t
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagaagcctggaatggtcccccctccgccgggagaagaaagccagacggtcatccttccacctggctggcagagctacctgtcgcctcagggccggcggtactatgtcaacacgaccaccaatgagaccacctgggaacgtcccagcagttctcctgggattccagccagccctggctctcacaggagctctctgcctncaacagtgaatggataccacgcatcagggancccagcgcaccctccagagactgcccacatgagtgtccgaaaatncaccggtgattcccagaacctgggatcctcatcgccaagcaaaaagcagagcnggagtggtggcctgtttggattcaggcccaggggccgagacattcccttcttcactcttttcc

SEQ ID NO: 370676 - DNA, 4493 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccaggtggtggcctgtttggattcaggcccaggggccgagacattcccttcttcactcttttcc

SEQ ID NO: 370677 - DNA, 4544 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctgggtggtggcctgtttggattcaggcccaggggccgagacattcccttcttcactcttttcc

SEQ ID NO: 370678 - DNA, 4377 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccaggggtggtggcctgtttggattcaggcccaggggccgagacattcccttcttcactcttttcc

SEQ ID NO: 370679 - DNA, 4304 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaagctgtgaaaaagaaagagaaaaagtctaagaccagtgaaaagaaagacagcaaagagagcagtgttgtgaagaacgtggtggactctagtcagaaacctaccccatcagcaagagaggatcctgcccgaagctggagtggtggcctgtttggattcaggcccaggggccgagacattcccttcttcactcttttcc

SEQ ID NO: 370680 - DNA, 4316 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagacattgacaagcagtacgtgggcttcgccacactgcccaaccaggtgcaccgcaagtcggtgaagaaaggctttg

SEQ ID NO: 370681 - DNA, 4095 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtggtggcctgtttggattcaggcccaggggccgagacattcccttcttcactcttttcc

SEQ ID NO: 370682 - DNA, 732 bp, Homo sapiens
gatctattaataaaatttgtcatttgcattattatctgttgcaaatgtgaaggcaaatagggtgtgattttgttctatattcatcttttgtctccttaggaaaaaccacctccggtcaataagcaggagaatgcaggcactttgaacatcctcagcactctctccaatggcaatagttctaagcaaaaaattccagcagatggagtccacaggatcagagtggactttaaggtaaaggtgttcagtgatcataaagtatattgagtgtcaaagactttaaataaagaaaatgctactaccaaaggtgttgaaagaggaaatcagcaccaactgggggaatgaataagaactcccattagcaggtgggtttagcgctgggagagctttggtcagtgttgttaggtcactgtttgtgaactgactgcagaacatacataatgaaacattcctatccatcctgagcagtatcagaggaagtaattccttcacatggaaagtatcaaaccatgatgattccttgagtcagcaaaactgtaagagaaattcaatcccagtgtattttcgcaatatattcaatatgaattgaacaactaggtgagccttttaatagtccgtgtctgagattaaaactttttaaagcagcagttatttttggactcattgaaatgaaatactctgacattgtgatgtcacactaattttatgcttttcatccttattttccatccaaag

SEQ ID NO: 370683 - DNA, 453 bp, Homo sapiens
ccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtgagtgaggagggcaagaaggaattgctgaaccacaagtactaacaaaaaagcactgatgtctcaaacagcatttgaaagcaggaaatgtatgatttgaagtcttcagttcaagaaaatcagctctctttctaactattatgtttaataataaagaaacagaaacaaaaaaaa

SEQ ID NO: 370684 - DNA, 618 bp, Homo sapiens
tttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaaggtacaaaacttggtaatagaactacagctgggcctctgtatcagtgggttctgtatccctggactcaaccaaccttggattgaatgtatctgggaaaaaatgagtagttgcctctgtactctatgtgaacagactttttcttgtcattatttcctaaacaatacagtataacaactatttacattgtattaggtatgataagtaatctagagataatttaaagtatatggtgggcggatcacttgaagccaggagttcgagaccagcctgagccaacatggtgaaaccccatctctactaaaaatacaaaaaattagccaggtgtggtggtgggcacctgtagtcccagctacttgggaggctgagggaggaaaatcgcttgaactttggaggcagaggttggggtgagccactccagcctgtggtgcagtctgtcactccagcctgggtgacacagtgagactccatctc

SEQ ID NO: 370685 - DNA, 6956 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagagctaacaacacagatcccatgtagttggagaaccaaaggccacatacatgacaaaaagactgaaccgttcaggttacttgcatggagttggtgcttaaatgatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttaggcttatgctccaacaatccccttacatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagacctactccaatgaagtccattgtgttgaagagattctgaaggaaatgacccattcatggccgcctcctttgacagcaatacatacgcctagtacagctgagccatccaagtttcctttccctacaaaggactctcagcatgtcagttctgtaacccaaaaccaaaaacaatatgatacatcttcaaaaactcactcaaattctcagcaaggaacgtcatccatgctcgaagacgaccttcagctcagtgacagtgaggacagtgacagtgaacaaaccccagagaagcctccctcctcatctgcacctccaagtgctccacagtcccttccagaaccagtggcatcagcacattccagcagtgcagagtcagaaagcaccagtgactcagacagttcctcagactcagagagcgagagcagttcaagtgacagcgaagaaaatgagcccctagaaaccccagctccggagcctgagcctccaacaacaaacaaatggcagctggacaactggctgaccaaagtcagcagccagctgcgccaccagagggccccaggagcacagagcccccacggcggcacccagagagtaagggcagcagcgacagtgccacgagtcaggagcattctgaatccaaagatcctccccctaaaagctccagcaaagcccccgcgcccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcagcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaagggtgaagcagaaagagactgtgataacaagaaaatcagactggagaaggaaatcaaatcacagtcatcttcatcttcatcctcccacaaagaatcttctaaaacaaagccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaagggttcttccggagatactgcaaatccttttccagtgccttctttgccaaatggtaactctaaaccagggaagcctcaagtgaagtttgacaaacaacaagcagaccttcacatgagggaggaaaaaaagatgaagcagaaagcagagttaatgacggacagggttggaaaggcttttaagtacctggaagccgtcttgtccttcattgagtgcggaattgccacagagtctgaaagccagtcatccaagtcagcttactctgtctactcagaaactgtagatctcattaaattcataatgtcattaaaatccttctcagatgccacagcgccaacacaagagaaaatatttgctgttttatgcatgcgttgccagtccattttgaacatggcgatgtttcgttgtaaaaaagacatagcaataaagtattctcgtactcttaataaacacttcgagagttcttccaaagtcgcccaggcaccttctccatgcattgcaagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaagaattctttgctcggctcagcacaaatgtgtgcaccttggccctcaacagcagtttggtggacctggtgcactatacacgacagggttttcagcagctacaagaattaaccaaaacaccttaa

SEQ ID NO: 370686 - DNA, 834 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggttcctcaacttaaaagggatgaggagaccttggagacggttctgaggagactcaaaagatgattatatgattggaagtcagtcctatgaggaaaggttgagagaatgaaaggttaagaggcaacttaataactcttcaaaaaacatgaatggatccattattaggaatggtaaccagcggtttcccagctccactgacagcagaataagagaaaataggtttaaaccgaaatcaggagtagttgtgtaaagaacttattggtaatgatggttgtcattacagtcatggtaaaaaggttaccaaaataattttattatcttctctggaagtatattttaaaagtacagtcctgcctacataagaataaaatgacctctt

SEQ ID NO: 370687 - DNA, 16963 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggtttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370688 - DNA, 16946 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370689 - DNA, 16963 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcaccatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370690 - DNA, 14768 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctccttgctcatgtgcgaacggccataattttgattctcaataatgagcgaggcatcatcagggtcagcattgctcgcagatccagaagcattgcacacataacggaaagatggtaggatagggagtcgtagac

SEQ ID NO: 370691 - DNA, 17083 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatcccgaatagtagattcagtgcccccttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370692 - DNA, 16903 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370693 - DNA, 13232 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacagacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370694 - DNA, 9215 bp, Homo sapiens
cgagtgactctatgaggatccccaatgtaggccattcctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttattgctgcacatggttaagcttccttttggctttggttggagagggtggagaaaagcgggaggggcatggcctgtgacctggtcacaaagtaccttccacagtcctttactttaaggtggcatcactaaattattccctgtagcccaccttcaggtccactccacactggctctcttgactattttcttcctttattcatcagtgatgtatgttcaggacctaattaattgtggatatgaggcagggtcaagaggacaaaggaacagggcctttaccttctacatagctcccctgtttcatccaaggaggttaagtattgatttttatcggttttctcaactgtgaatataataaactgaaagcatttcagggagaagctggagaacaccttctctagctgcactccaccttaaggctgaagctggatttgtt

SEQ ID NO: 370695 - DNA, 5145 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggtggtggcctgtttggattcaggcccaggggccgagacattcccttcttcactcttttcc

SEQ ID NO: 370696 - DNA, 4657 bp, Homo sapiens
  misc_feature (4582)..(4582): n is a, c, g, or t
  misc_feature (4591)..(4591): n is a, c, g, or t
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgncagagaagntggagtgtggtggcctgtttggattcaggcccaggggccgagacattcccttcttcactcttttcc

SEQ ID NO: 370697 - DNA, 4534 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacgaagctggagtggtggcctgtttggattcaggcccaggggccgagacattcccttcttcactcttttcc

SEQ ID NO: 370698 - DNA, 4848 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggtaaaggtgttcagtgatcataaagtatattgagtgtcaaagactttaaataaagaaaatgctactaccaaaggtgttgaaagaggaaatcagcaccaactgggggaatgaataagaactcccattagcaggtgggtttagcgctgggagagctttggtcagtgttgttaggtcactgtttgtgaactgactgcagaacatacataatgaaacattcctatccatcctgagcagtatcagaggaagtaattccttcacatggaaagtatcaaaccatgatgattccttgagtcagcaaaactgtaagagaaattcaatcccagtgtattttcgcaatatattcaatatgaattgaacaactaggtgagccttttaatagtccgtgtctgagattaaaactttttaaagcagcagttatttttggactcattgaaatgaaatactctgacattgtgatgtcacactaattttatgcttttcatccttattttccatccaaagttgtgtaattgtaaaactttcctaagtgacctttctctctccacaggtggtggcctgtttggattcaggcccaggggccgagacattcccttcttcactcttttcc

SEQ ID NO: 370699 - DNA, 5330 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcaggtacagaaggttggagtctttttatttcagttttcttctttctaggtactactacatttattagcctctagagcactttaaacctaaaattatggttgtggatgagatattaggaggtggtgatcaagtaggaggggggaaatagagatgatcagtactgcggcgggtaggcctaggagtggtgggggcagatgtagatgggcgaagcagattgtcgttcactttggtcctcaggggttgtaataattattattatgagtgggctttgatgagggaggtaggtggtaggtggtgtataatattagtagttgggtgatgaggaatagtgtaaggagtatgggggtaattgatggtgggccatacggtagtatgaagtgggggcattaatatcagcagtagtgagagccatggtcatccccttatgagcgggcgcggtgataataggcttgcgctctaagattaaagatgtcctagaccactttttaccaggaggcaca

SEQ ID NO: 370700 - DNA, 4301 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggtggtggcctgtttggattcaggcccaggggccgagacattcccttcttcactcttttcc

SEQ ID NO: 370701 - DNA, 5050 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcagtggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggtaaaggtgttcagtgatcataaagtatattgagtgtcaaagactttaaataaagaaaatgctactaccaaaggtgttgaaagaggaaatcagcaccaactgggggaatgaataagaactcccattagcaggtgggtttagcgctgggagagctttggtcagtgttgttaggtcactgtttgtgaactgactgcagaacatacataatgaaacattcctatccatcctgagcagtatcagaggaagtaattccttcacatggaaagtatcaaaccatgatgattccttgagtcagcaaaactgtaagagaaattcaatcccagtgtattttcgcaatatattcaatatgaattgaacaactaggtgagccttttaatagtccgtgtctgagattaaaactttttaaagcagcagttatttttggactcattgaaatgaaatactctgacattgtgatgtcacactaattttatgcttttcatccttattttccatccaaagttgtgtaattgtaaaactttcctaagtgacctttctctctccacaggaggattgtgaagcagaaaatgtgtgggagatgggaggcttaggaatcttgacttctgttcctataacacccagggtggtttgctttctctgtgccagtagtgggcatgtagagaactcgccgtgtgtgtgtcagagaatgttgctcctgtgccctgagtcaacaaagacggcccctgtgagctcaagggcagttgggaaggtgtagcgaacatcctgtaaaacgtcccatcttgattctgtttcactgaggccatctatcc

SEQ ID NO: 370702 - DNA, 1153 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcaggtacggccaattaagtgcatggtgccttttaagttttgtttgttaggagattgtggcttcctcttgccttctttacatgtaaaggatgctctaccatacttgggttaggaaatggctgatgagctagacttctttttatttatttatttatttattattgttatactttaagttttagggtacatgtgcacaatgtgcaagttagttacatatgtatacatgtgccatgatggtgcgctgcacccactaactcgtcatctagcattaggtatatctcccaatgctatccctcccccctccccccagctagacttctttatgggactcttatctatcaggccacattgggtttattctttctctctgggaactacttggggcatgggaagtaggtttccacagaattactgggaaatctggtaggcaaagtgaaggtaacctagtaagagtatcctcagatttacacattttgtgttatgtggtagtgtatatgtctttgggaataatttggccattattttttttggatgaaatttggtccactattgtcaaagaaccaaaaacaaaatattggcattatgtgaaacatttttacctgattcttgaaaggctgtattaaaataaaaaa

SEQ ID NO: 370703 - DNA, 269 bp, Homo sapiens
gtcctgtggatcttctgaaaaatcaagtgcagctcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgac

SEQ ID NO: 370704 - DNA, 1829 bp, Homo sapiens
aggtgtaatgatagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370705 - DNA, 1937 bp, Homo sapiens
ggcagacacccagccactctgagcagaactgacagcatgaaggtacggggcccagggtcgggggactcatagcatgggggaactgagcccactccagaggcccctggccacagagggcactatgaaggcacaaggagttctcttgaaactcgcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370706 - DNA, 1163 bp, Homo sapiens
  misc_feature (11)..(11): n is a, c, g, or t
  misc_feature (21)..(21): n is a, c, g, or t
  misc_feature (32)..(33): n is a, c, g, or t
  misc_feature (57)..(57): n is a, c, g, or t
atttcggcacnaggaagatgngagggagggtnngacattgagtacttcccccagcangatggggtgggaggattcaggagatgagagggagggtggacattgagtacttccccgagcaggatggggtgggaggattcaggagatgagagggagggtggacattgagtacttcccccagcaggatggggtgggaggattcaggagatgagagggagggtggacattgagtacttcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370707 - DNA, 1225 bp, Homo sapiens
aggtgtaatgatagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370708 - DNA, 1828 bp, Homo sapiens
ggcagacacccagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370709 - DNA, 1604 bp, Homo sapiens
aggtgtaatgatagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctga

SEQ ID NO: 370710 - DNA, 1734 bp, Homo sapiens
aggtgtaatgatagccactctgagcagaactgacagcatgaaggcactcctggccctgccgctgctgctgcttctctccacgcccccgtgtgccccccaggtctccgggatccgaggagatgctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggttttccagaagagattcaatggctcagtaagtttcttccgcggctggaatgactacaagctgggcttcggccgtgctgatggagagtactggctggggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaaggaaaat

SEQ ID NO: 370711 - DNA, 1151 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370712 - DNA, 1524 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggaaaaaaaaaaaaaaaaaaaaaaaaaaaaaaactgtgtgtgtggggcggcattgggccctggagaaaaagtctcttcaagaacccattgcggttgggggcgggggggccccagtgttgggttaggtgtgaccttgggcaaaagagggtgtccccaagagaacaccccgcggcacatacgacacatggtgtcggtggctttcctcacccaaaaataaaaaaaagcgccccgggggggacacaacgcgacgcgtctcctgggaaaaccaatccccgaaaggggaggtctcagagaggcaccacaccgggctcccaaccacacgggatccccaagggcgaagcccaaaaataagaatagccgcgacggatggggagc

SEQ ID NO: 370713 - DNA, 1174 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcggccagttgcacaaggatttcttat

SEQ ID NO: 370714 - DNA, 1052 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370715 - DNA, 1477 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcggataatcaaagtccattggcttagccccagcttgcttgtaaatgtaaacccagaccaggcactgaagctgccaagagtgaagaccgagaggcctggctgccagccctgacctggcccaacctggaggactggggccagtggctgggcctcgcggggcttcctctctgcacctgatccaggatgaggtggttgggttagatgactctccaagctcctttctggccagagacatgaagggaacaagcacagagatgagaagcagacaggattgcccgagtaattagccctatggcctgtgaacttcctctcccctctctccactgcagatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370716 - DNA, 1361 bp, Homo sapiens
ctcgaccatttgatgagcctcccacaggcactcttcgtctcccagcacccgaatctcatctacaagtgagggggctgggctaggtcagccttcctcacacttgagcgctggatgaccctgagaaagggaaagggtgctgccttgacttagttgagtctaatattgtttaatatgtacaaacgtaaacctagatgtaaaggcctcggcttctggctctaatacggctatgaagccagaatggaacagaaagtcattacaaatgaaatgcgaacaacgccactacaccacaaatcatgggaacgttcagatttttttaacccaaattaaaatttcatccttttcttctcttttggtccaggataatcaaagtccattggcttagccccagcttgcttgtaaatgtaaacccagaccaggcactgaagctgccaagagtgaagaccgagaggcctggctgccagccctgacctggcccaacctggaggactggggccagtggctgggcctcgcggggcttcctctctgcacctgatccaggatgaggtggttgggttagatgactctccaagctcctttctggccagagacatgaagggaacaagcacagagatgagaagcagacaggattgcccgagtaattagccctatggcctgtgaacttcctctcccctctctccactgcagatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370717 - DNA, 2771 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcagacaaactagagcaatgcctatgtaagaacaaggactctcaagatcctgctacacagtattcacaatcaaaagggcccaagattcaggaccacctaaagacaactgacaaaaagtgtcagagccagaggcaacctctgctagatgaagcagcagcacatgactccatttctatctgataaggagacagagaagaggcatctcgaacagatgaaaaaccaaaggctggtgtcctaaaaaaaacagattggcttcaaagaaaacactaaggaagacccacagagctgtattaattttagtaaaaataatcatatgccaacaggggaattgaaccactttctaaatcatagtatgaactcatctcttcagatacttggtaagtggtcaaagcttgtttttataattactttcactgtcttgggcaaaaagtctttcttatctttggtccttaggtgtggtatcagtttcttccatttttttatgtgttacaaaacaatcttttttttacttgacatcaacaaccaaggtgcagtataaacacgaagttgctgatattgttgcttttatacacataaaataccaacatctcccatacattttataggctatacgaaggtctcaaagaattaataaccgttatccaaaaatattataacatttaaggctgagtgaaatacagtaaagcctggtaatatatgttaaggaaaaaaacctagaccaacattttaaatattggtttcttaaatatgttaaattcccattaacagaacataatctaagcatcaaaacaaacagctaagcaaattaatttaaaaataaaacaatttctaagtagatgaatataatcacgatgtttatacagctataaagcataatttggaagctaagcctagtaaaagaatgacctgtaacagaatgacagaatcatttatcaaccgttgagctgtgtgatttaaaaacaattgttttctcctcctcccaccaaaatctccatttgagataagtttcaattattatttaaaaaaaaattttttttaacttatctggcctactttgtggtgactgacacaatattgataaaactgccttcttgaccttccccttgctctccaaaagaagtggtttaaacaattaacaaattttacaagagcttctgccagggctcaggcaccacaatgcagggtcactaccttaggtaacatctgctccccagagtctttaggcattaagtggctcagtgagggcttcagccctagtggtattttcaggttttctcagctgggactcctgtcgtttttcatacagcatagtgataaagtcaagtaggaacataaaacttgctataaatccaaacacctgaggaaaaaaaggaggaaaggttatatgagaattttggaatataatcttacatttcctacttggcttggagaatgtttcatataaacaagatgttcatgaattttatcttatacacgactactctttaatggtaaaaaaaatttttttaagtcatcaaaaaatggaaagaagttataaaagaaaaacttccagaataatggctattagtcaaagtctcacaaaatattaatgttctgccttatgtgtgcatgtttatatgtggagggctaatatatgaaagtagggttaacagataaacattaaatcctataaaatgatacaaaacaaaaatatttgcatggttagattgacccacagatgcgataaggaaaatacgtgactaggcaactcagcctaggtgaaaatgaaaaaagttattaatatcaaaacagaaattccattttgaagatactattaggttaaattacttaaataatgttccagttgtcacactgcaatgacacagtgacatgacgccactacctacttcctcttccttaaatcacttcctcaactgt

SEQ ID NO: 370718 - DNA, 982 bp, Homo sapiens
cacctcggcctccccaagtgctgggattacaggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcggaacttctgcactatttaatcggtaccctgctcctcctcatcgcctccattgtggcagcttccaagagttacaaccagagcggactggtagccggagcgatctttggtttcatggccaccttcctctgcatggcaagcatatggctgtcctataagatctcgtgtgtaacccagtccacagatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370719 - DNA, 970 bp, Homo sapiens
ggcagctgcccggggaggcggccagcgagctggggccgcgcaatgtcgcacggagccgggctcgtccgcaccacgtgcagcagcggcagcgcgctcggacccggggccggcgcggcccagcccagcgcgagccccttggaggggctgctggacctcagctacccccgcacccacgcggccctgctgaaagtggcgcaaatggtcaccctgctgattgccttcatctgtgtgcggagctccctgtggaccaactacagcgcctacagctactttgaagtggtcaccatttgcgacttgataatgatcctcgccttttacctggtccacctcttccgcttctaccgcgtgctcacctgtatcagctggcccctgtcgatgcagccgtctgatgaggccacaacccctaggcccctcaggagctttgcagagaggaggacgtgtactccaggcgaggcctctggacctgtgttcctgtgccaaagtcctgtcaggctggtgggcaccaggaaaggcctgcaccctcttcctgctctcccaggaagccagctccctgagctcctgagccagccggaaactcttcctccagccttccggggagaacatccctcccattctgggaaaggaaagcagcctccagggaaatgttttctgccttcctgcttctagaaccacctcaggtactgatgaaccccacttagcacagctgaaggggtttgtgaatactcccgcctaaatcccttctacttcactcctcaggggagtgaagtgccttaagaaacaaagccctgtcctaatttatctagcttgtcagtccggtcttagagataccctctttcctgaagtgaggcgtgcctgtagaaacactatgtggtcagcctgtccccaaggagatcttgtgtctcctctccatctctgcctttgttaccagtgtgcatgtgtttgtgtgttttttaataaaatattgactcgg

SEQ ID NO: 370720 - DNA, 9362 bp, Homo sapiens
  misc_feature (7538)..(7538): n is a, c, g, or t
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370721 - DNA, 3741 bp, Homo sapiens
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgaaaaaca

SEQ ID NO: 370722 - DNA, 970 bp, Homo sapiens
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgcgtgaccgaattacaagttttagaaaatctactgtcaaaaaagaaaaaaaaaaaaaaacaaaaaaacactgggtgggcgaccctgggccctcagaagaagtttcctaaacccatctgcgttgaggggcgcggggcgccaatggggtaggagcaccgtgggcagaaggtggtccacagagaacccggggcgccatgaaaaagggcggagggagatccccacgcaaatataaaacaacacggcccgggggaaacacagaagctttctggacacaatgcaggaatgggggagacccgagggagggcacaaaagggaggggacaccctacacacggggaggggctcacaaaagagggaacgtcccagcatatccaaattgaaggccggacgtcgggggaggggagaaagagaaagcgacgcaagcacccgacgagcaacaatcgagacagagaccaagaggcgagcacgagatcgtaggagtcacagccacg

SEQ ID NO: 370723 - DNA, 9380 bp, Homo sapiens
  misc_feature (7556)..(7556): n is a, c, g, or t
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctatagttggaagtaaagttgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370724 - DNA, 9347 bp, Homo sapiens
  misc_feature (7523)..(7523): n is a, c, g, or t
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctatagttggaagtaaagttgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370725 - DNA, 9327 bp, Homo sapiens
  misc_feature (7503)..(7503): n is a, c, g, or t
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatgaggacatgaaccttaacgaagagcagtatatctctgtcactgacaaatctatagtttgaagtaaagttacgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagctgggttaacaactttggccatgaaggtcttggactcttattggatgagctggaaaagcttctggacaaaaaacagcaagaaaatattgacaagaagaatcagtataaacttattcaatgcctcaaagcatttatgaataataagtttggattacaaaggattctaggagatgaaagaagtcttttactattggcaagagcaattgaccccaaacaacccaacatgatgactgaaatagtaaaaatactttctgctatttgcattgttggagaagagaacattctagataaacttttaggggctataacaacagcagcagaaagaaataacagggaacgattttcaccaattgtggaaggtttagaaaatcaggaagccttgcaattacaggtggcctgcatgcagtttataaatgcccttgtcacttctccttatgagcttgattttcgaatacatttaaggaatgaattcctccgttcaggactaaaaacaatgttaccagatctaaaagaaaaagagaatgatgagcttgatattcagttgaaagtatttgatgaaaacaaagaagatgacctaactgaattatcacaccgtctcaatgacattcgagcagaaatggatgatatgaatgaagtctaccatcttctatataatatgctgaaggacactgctgctgaaaattacttcttatctattctacaacattttttgcttatcagaaatgattattatatcaggccacaatattataaaataattgaggaatgtgtttcacagatagtgctacactgcagtggtatggatccagacttcaaatacaggcaaagattagacatcgatttaactcatctgatagattcttgtgtgaacaaggcgaaagttgaagaaagtgaacaaaaagctgcagagttttcaaagaagttcgatgaagaattcacagctcgacaggaagctcaagcagagcttcaaaaaagagatgagaaaatcaaagaacttgaagcagaaatccagcaacttcgaacccaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaagattgaacccacagaattatctgagaactgtttctggttaagagtcaaagaagacaagtttgagaatccagatctctttgccaaattggcattgaattttgctactcagataaaagttcaaaagaacgcagaagcattagaagaaaagaagactgggcctacaaagaagaaagtgaaagaactgagaattttggatcccaaaacagctcagaatctgtccatctttctgggatcatatcgcatgccatatgaagacataagaaacgttattctggaggttaatgaagacatgctgagtgaggctttaattcagaaccttgtgaaacatcttcctgagcagaagatactcaacgaattagcagagcttaagaatgaatatgatgacctctgtgagcctgaacaatttggagttgtgatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaagatcagagatactaaatcagcggatcaaaaaacaacccttttgcattttattgccgacatttgtgaggaaaaatatcgagatatcctaaaatttcctgaagaactggaacacgtagaaagtgcaagcaaagtttcagctcaaattctcaagagcaaccttgcatcaatggaacaacaaattgttcatctggaacgtgacatcaagaaattcccccaagcagaaaatcaacacgataagtttgtggaaaagatgaccagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggaagcagtgagagaaaacaataagagaagagaaatggaagagaagaccaggagggcaaaacttgcaaaagagaaagctgaacaagaaaagttagaacgccagaagaaaaagaaacaactcattgatataaacaaagagggtgatgagactggtgtgatggataatcttctagaagccctacaatcaggtgcagcattcagagaccgtcgaaagcggattccaaggaatccagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370726 - DNA, 5830 bp, Homo sapiens
  misc_feature (25)..(25): n is a, c, g, or t
  misc_feature (4006)..(4006): n is a, c, g, or t
aatagataatatgatatattttgtntgtgggatgattttattaataattttcgttgccctataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370727 - DNA, 1061 bp, Homo sapiens
gcggggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattgaacattcaaataaaaactttggcagatgatgtgcgtgaccgaattacaagttttagaaaatctactgtcaaaaaagaaaaacctcttattcaacatcctattgattctcaagtcgcgatgagtgagtttcctgcagctcagccattatatgatgaacgatctttgaatttgtcagaaaaggaagtattggatctctttgaaaaaatgatggaggacatgaaccttaacgaagagaaaaaagctcctttacgaaacaaagactttaccaccaaacgtgagatggttgtccagtatatttctgccactgccaaatctatagttggaagtaaagttgggtgggctgaaaaacagcaaacatgaatgcaccctgtcttcacaagaatatgttcatgaattacgatcgggtatatcagatgagaaacttcttaattgcctagaatccctcagggtttctttaaccagcaatccggtcagtggggttaacaactttggccatgaagggcttggactcttttttggaagagccgggaaaaactttggggccaaaacaaaggaggaaaatttgggccaggaaaaata

SEQ ID NO: 370728 - DNA, 304 bp, Homo sapiens
tttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtg

SEQ ID NO: 370729 - DNA, 404 bp, Homo sapiens
aatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgaaaaa

SEQ ID NO: 370730 - DNA, 5821 bp, Homo sapiens
  misc_feature (3997)..(3997): n is a, c, g, or t
cattcgtaatatatattaccttttattaaattatttattcttaaaaacacaataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctggaaaattctattacgtttatttagatttcaaaggcaaatattgattcctatgctctgtggtttatttcttttttctattgcttctttctcccttgagtcccttgaaggcagggaaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttcttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgttagaaaatactgtttctactcattcaaagcacattgtagatattcagagagaagaacaaatggctggcttggcaaatccccatctgagataaagtaaacaagtgaccagcagcccacagataattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttcagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccattatctcctttggctgctgtaacaaattaccaccaataatatgatggcttaacacaacagaaacttatttgcttacatttttgaagggcagcaaagccatggctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaatcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttctatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttttacaatcattcagattgtgaattcnaggctcagaattacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcataccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacatccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaaaaaaaagct

SEQ ID NO: 370731 - DNA, 3718 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370732 - DNA, 249 bp, Homo sapiens
ccaacatgtggagaagttgggtgtccaccctgccccaggatggacacccaacatgtggagaagttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370733 - DNA, 3664 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370734 - DNA, 3695 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370735 - DNA, 4153 bp, Homo sapiens
  misc_feature (3761)..(3761): n is a, c, g, or t
  misc_feature (3763)..(3763): n is a, c, g, or t
  misc_feature (3765)..(3765): n is a, c, g, or t
  misc_feature (3770)..(3770): n is a, c, g, or t
  misc_feature (3772)..(3772): n is a, c, g, or t
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcaaaaaaaaaaaaaaaaaaaaaaataaaagaaaaaaaaaaaaaananangaaananaaaaaaaaaaggacaaagaggaaataggtctatactagtataacaactgtctcaggcttagaggaacatctgaaatagagtagtatgctatgttggctaaaactggtgtcatcactacagtggcataatattgaactgggcagcagcatgcggaaaatactacagagtgtgcacagtggctatcattgatccaggtgactctgacgatcatatagcaagcatgggagaacagactggttgaaaaagtaaaccgttgttgtaccctacgagaaatttcattcgtggcaaaaccgtttaaaagacttgtgaagagatttgtgccgtgtataagtaaaaattgagcattggttttaaaaagcaaaaaaaagaaataaaacaggg

SEQ ID NO: 370736 - DNA, 3889 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaaggtgtgttggggccacccccctgcaccctgccccacaatcttgtccttcctttgggccctctgtggagtccctgaatttctgtgtccctccaccccagggagcactagccgagagacagcacaccagcatggatctcccgaaattggccagtgacgaccgcccagtgagtgcccaaggcagagaggggcgggggctctgatctggccaggcctgaccgcccaccctcaccctctacagagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370737 - DNA, 3493 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370738 - DNA, 1506 bp, Homo sapiens
tcggcacgaggcctggctactgctcgcctcggctgattgttggtagatgccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370739 - DNA, 2977 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370740 - DNA, 2253 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370741 - DNA, 686 bp, Homo sapiens
cagagcccaagaggaggaagtacggcggcatatccacagcctctgtgtgagtggctgggccaggtgagggggtctggagcccggggccggggccggcaggccgaccactcatgctgtgcaccgcccctgcagagacttcgagcagcctactcgggacgggctgggcagtgacaacattggcagtcggatgctgcaggccatgggctggaaagagggcagcggcctgggccgcaagaagcagggcattgtaacgcctatcgaggtgagtctcaggcagtcctgtcccatcccccagcacccctcacagcatcccccaccagcctgacagagcctgcctccctcacacaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctg

SEQ ID NO: 370742 - DNA, 415 bp, Homo sapiens
gaggtgaggtgtgacctgaccctgggctccctcccctgtgtcccttccaagtccccatcacctcaggcagctggagttcaatttctcacgtgttaaccccgtgagccttcttccccattttcctatcctggctgcttgtgcctgtgatggcctgaccctcaggacctgagcctcattagccagatggcatgccctgtgggaccccactccccatgcctgtgttgcctgagaaaagagaccagctccccaacattcacatacacatacaaactttcaagaatgacatggagcaaatgaagtaccgggaccgtgcagctgaacgcagagaaaagtatggcatccccgagccgccagagcccaagaggaggaagtacggcggcatatccacagcctctgtgtgagtggctgggccagg

SEQ ID NO: 370743 - DNA, 284 bp, Homo sapiens
ccggctactactatgacccccagaccggcctctactatgaccccaactcccaggtaatagggcagcccagggagggatgggatcgggtcaggtcgcgtcaggaacagctagccctgcaggttcccttcacaaggtcttccctcacatcccctcttccctcctcctccctcagtattactacaatgctcagagccagcagtacctgtactgggatggggagaggcggacctatgttcccgccctggagcagtcggccgacggacataaggagacaggggcaccct

SEQ ID NO: 370744 - DNA, 3487 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370745 - DNA, 4173 bp, Homo sapiens
  misc_feature (3761)..(3761): n is a, c, g, or t
  misc_feature (3763)..(3763): n is a, c, g, or t
  misc_feature (3765)..(3765): n is a, c, g, or t
  misc_feature (3770)..(3770): n is a, c, g, or t
  misc_feature (3772)..(3772): n is a, c, g, or t
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgcaaaaaaaaaaaaaaaaaaaaaaataaaagaaaaaaaaaaaaaananangaaananaaaaaaaaaaaaaaaaaaaagagaaaaaaaaaaaaaaaaaaacaaaacaaacaggaacaaacgaggagcaaaaaaagacgcacacaacacaaaaaagccgaccagacagtacaaaagacaggaaggagcggggacaaacacgacacacaggagaaaacgacaaccgaaggcgcaccgccacaccaggggcgcgaccacccgacggcaaaaacgacccaccggcacaagacacaagagatcgcggagcaatatctgatagcacagctcacaagggtctatcctgggggcgttcccacaagagctgtcccaggcgcaggacgcatcctctgagatagattgggggttaacatgccacatgatcaacttgacagagccgttgcaaacagggcttacggggcaga

SEQ ID NO: 370746 - DNA, 2404 bp, Homo sapiens
cctggcatctaccaacaatcagccgaggcgagcagtagccaggcactgctgtacaattaagtgtggcgccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370747 - DNA, 3141 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtgcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370748 - DNA, 3718 bp, Homo sapiens
  misc_feature (3203)..(3203): n is a, c, g, or t
  misc_feature (3205)..(3205): n is a, c, g, or t
  misc_feature (3208)..(3208): n is a, c, g, or t
  misc_feature (3233)..(3233): n is a, c, g, or t
  misc_feature (3237)..(3237): n is a, c, g, or t
  misc_feature (3273)..(3273): n is a, c, g, or t
  misc_feature (3277)..(3277): n is a, c, g, or t
  misc_feature (3279)..(3279): n is a, c, g, or t
  misc_feature (3282)..(3282): n is a, c, g, or t
  misc_feature (3285)..(3285): n is a, c, g, or t
  misc_feature (3288)..(3288): n is a, c, g, or t
  misc_feature (3291)..(3291): n is a, c, g, or t
  misc_feature (3303)..(3303): n is a, c, g, or t
  misc_feature (3305)..(3305): n is a, c, g, or t
  misc_feature (3313)..(3313): n is a, c, g, or t
  misc_feature (3322)..(3322): n is a, c, g, or t
  misc_feature (3339)..(3339): n is a, c, g, or t
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgcnanagnccaaaaaaaaaaaatacagcaaaanatcnacaacctatgtaaacttcgaaaaaaaaaaacaaaanaaantnaanaanaanaanattagcaatcanangcaacaanccatgagcnaaaaaaaaagcagcaanctggaccccaaaaaccaaggcattttaacgcctatcaaaccccaaacaccggttccgcgcccccccctgggttcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370749 - DNA, 1802 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcagcactccctcaacatcctgggccagaaggtgtcgatgcactacagtgaccccaagcccaagatcaatgaggactggctgtgcaataagtgtggcgtccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370750 - DNA, 2026 bp, Homo sapiens
gcttattgatgggtctgctcatttcctgcataggaagaaatcggtgacattgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtgcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 370751 - DNA, 295 bp, Homo sapiens
gggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagt

SEQ ID NO: 370752 - DNA, 362 bp, Homo sapiens
  misc_feature (250)..(250): n is a, c, g, or t
  misc_feature (264)..(264): n is a, c, g, or t
  misc_feature (267)..(267): n is a, c, g, or t
  misc_feature (330)..(330): n is a, c, g, or t
  misc_feature (350)..(350): n is a, c, g, or t
gtatggcaagggtcacagagagtgactggacctggtttggaggactagttaagagaccttttggaggtctctgcagctcccggccccttattggagtccaagcccagagccaattcccccagtggccataaggtggcagcctcaccctctgcctggctggactgagaagaggctcccattcagagctctggcacacaggagtcctctcctttatcggaaaactgcagcgctgagagaacgcgaacactancaggtgcctgccanccncgtctggctaatttttgcttttgttttttgttgttgttttgttttgttttgtttttttgagancagagtctcgactgtgtcanccactgcagtcc

SEQ ID NO: 370753 - DNA, 1644 bp, Homo sapiens
  misc_feature (47)..(48): n is a, c, g, or t
aggtctagaggatcccttaaactaacaaatgtgatcctgcttcttgnntagtttttgagggtcttctgttctttgaaataatctaaaactcacagcatgagatacatgctgctcactagatgaaatcagctctccattcagcacttgagattgttttaaaagcgctgaatggagagtctccgtcgaactagttcgacggagactctcctggggctgcctgagactggaaccccaggagaggcgctgaggtacctctggtttggaggactagttaagagaccttttggaggtctctgcagctcccggccccttattggagtccaagcccagagccaattcccccagtggccataaggtggcagcctcaccctctgcctggctggactgagaagaggctcccattcagagctctggcacacaggagtcctctcctttatcggaaaactgcagcgctgagagaacgcgaacactacatcaggctgggccctgggtggcgatctggactccagactaatgaactcctgaaccctgccccaaggcctgtgttactccccagcagcagcccagcccttctccccagtcatccaagtgggtacctctctgaaaatccttggaaaggggatccaggacatgaggggaccctgtcccatggggtcccctgctctccaacacacaggtagtcccagtgctagcattggtctaggtaagggtcacctctgcctttgtgcagtggtgtgatctcagctcattggagtccgcctcctgggctgaggcaggagaatcgcttgaactgagaggcggaggttgcagtgagccgagatcgcaccactgcactccagcctgggcaacaagaaggaaactctgtctcagaaaaaaaaaaaaaaagaatgaagtttcctcaccctctccaggacaatctcttcacttcatgagcacccatgaagacgcaccatgaaggagccattcactgagtatttaccaggccctcttcagtatgcagggcacactacggtgagcaagacagctgtgggcccgccctcactgaactcaccacctatggggatgttccattacaaattgctggggaggccaggcacgatggctcacacccataatcccagcacgttgggaggcaaaagcaggtggatcacttgagctcaggagttcaagaccagcctggggaaaatggtgacaaccagtctctacaaaaaatacaaaaattagccaggcatggaggcgcacacctgtaggcccagcaacttgtaggactgaggcgagaggatcacttgagcccaggaggtcaaggctacagtgagccatgttcatatcactgcacttccgtctgggagacaaagtgagaccctgtctcaaaaaaaaaaaaattgctgaggaatgctgtgagggaaattagagggacttacagagcacgtagcaagggacctgactccatgtgaaagaactcaagtgcaccagcctggccaacatggtgaaaccgcatctctactgaaaaatacaaatattagccgggcatggtggcgcatgcctgtaatcccagttactcaggaggcggaggttgcaatgagccaagatcgcaccattgcactccagtctgggagacagagcaagactctatctcaaaatcac

SEQ ID NO: 370754 - DNA, 553 bp, Homo sapiens
cccccctcccccctagataagagcagctccagcgcaggtcagttgggcctgtgagggccatggtgttgggcagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370755 - DNA, 3556 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggtgagttggtggtgtgtatatacagttagaggtcagaatcaagattctcctacagtgattctgagcttttatcccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370756 - DNA, 2867 bp, Homo sapiens
  misc_feature (8)..(8): n is a, c, g, or t
  misc_feature (47)..(47): n is a, c, g, or t
  misc_feature (51)..(51): n is a, c, g, or t
  misc_feature (65)..(65): n is a, c, g, or t
  misc_feature (81)..(81): n is a, c, g, or t
  misc_feature (90)..(90): n is a, c, g, or t
  misc_feature (94)..(94): n is a, c, g, or t
  misc_feature (106)..(106): n is a, c, g, or t
  misc_feature (118)..(118): n is a, c, g, or t
agaagcanacgtatctcgacaggtggtatctccagctgcccactttngcgnatcaccagaggctngcatatctctgctaangttagcgtntagngacgtgtgtccncgaggtagtcgngagaagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggtgagttggtggtgtgtatatacagttagaggtcagaatcaagattctcctacagtgattctgagcttttatcccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370757 - DNA, 1603 bp, Homo sapiens
taccacacctcagtttaaatcggcacgaggccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370758 - DNA, 2484 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370759 - DNA, 1128 bp, Homo sapiens
caaacttaggctaggtagcgaggctgggtgtcgctgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370760 - DNA, 411 bp, Homo sapiens
agtgagctgagatcgcgccactgcactccagcctgggcgacagagcgagacgccatctcaaagaaaaaacaaaaagttcctgacctttccacacaggtcctcgtggtccgcggactccagagtggttctagctttctattaatatcacacagttttccttatttaagttatgcaaagggtcgtgtgcctgggactgtgagattctaccaccatgattcctacagtgacttttcctttcagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggag

SEQ ID NO: 370761 - DNA, 233 bp, Homo sapiens
agctcctcctcctccctccatgcgactcgaacctatgggggcagctatgggggccgtggccgtggccggaggacaggcggtcctgcctatggtgagacagttatgggaacaggaggcaaggagtggcagggcttgtgggtagaggcagaggtctggatggaagtttggggaaatctggaatggagatgatgaaaaagtgattgattggctgggaggcttgtgagtgagaagga

SEQ ID NO: 370762 - DNA, 437 bp, Homo sapiens
caatgaacaggaaccttgtggctggtggctggcccgggtgcggatgatgaagggagatgtgagtgactgggaatgcctttggagaactactgaaacaaatatgttattcatagaaagttgctcaggtcatccacaacttctccttttttaccatgtgccagttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcgtgagtgttaaggatggtgggaatgagggccctctttacagccctaatctctggctttatttctcccaggcatcactcccactttgcagttttctctgttgttcccctggccctctactagagccct

SEQ ID NO: 370763 - DNA, 460 bp, Homo sapiens
aaatgccaggagggcttggatggtagggaatgtctcccacctgaatttctactcaccgcttcttgcttttctgttttctttcccactttcccctcagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgcc

SEQ ID NO: 370764 - DNA, 2990 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370765 - DNA, 2319 bp, Homo sapiens
tcgactctagaggatccccatggcgctgatgactacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370766 - DNA, 3077 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggcaaagtgattggaaagaacgggaaagtgatccaggagattgtggataaatctggtgtggtgagggttcgagtggaaggtgataatgacaagaagaaccccagggaggagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggatatagcactgatgagagctcctcctcctccctccatgcgactcgaacctatgggggcagctatgggggccgtggccgtggccggaggacaggcggtcctgcctatggccccagctcagatgtgtctacagcttcagagactgagtcagagaagagagaggagcccaaccgagctgggcctggcgacagggatcccccaacccgaggggaagaaagccggaggcggccgactgggggccggggtaggggacccccacctgccccccggcccacttcgagatacaattcttcatctattagctcagtgctgaaggatccagacagtaatccctacagcctattggacacgtctgaaccagagcccccggttgattcagaacctggggaaccccccccagcaagtgccaggcgccgccgctcccgccgccgccgcactgatgaagacaggaccgtcatggatggaggcctggaatcagatgggcccaacatgacagagaatggcctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagaggcagctgtgtctgatggagtttagaccagtgtaaactttgaataggatagagaagaaagtgtggttcacattttctggatcccaaggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370767 - DNA, 3050 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggtgagttggtggtgtgtatatacagttagaggtcagaatcaagattctcctacagtgattctgagcttttatcccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggaggtagagcagcttcgcttggagaggctacaaattgatgagcagcttcggcagattgggctgggctttcgccctcctgggagtgggcggggcagcggtggcagcgacaaggctggaagatgaatcaagacctcaacgtcgtaatcgcagccgccgccgccgtaaccgtggtaatcggactgatggctctatcagtggagaccgccagccagtgactgtggctgactatatctcacgagcagagtctcagagccgccagaggccacccctggaacgcactaaaccctcagaagactctctttcaggacagaagggtgactctgtcagcaagcttcctaagggcccctcggagaatggggagctctccgcccccttggagttgggtagtatggtgaatggggtttcataaaacctccaacctgcacccctcccttctccatctcgcttgctgcccaacaccatggccctcacaggcccaactgacctgcgctggagctgctcttatctaggggggaggggggtggcacagcagcttgggtaccccccaacctccaggagctagtggaggggtgtgtaacagggtcataccccctccctcttgtccaccctacccccagggtaaggggagcctctctccttccccatcagactggatgtgcctttatcctctaatgccccaatctctctctgaacacccccattctccacctgttggtggggggtgctcctcgacccacccagatttgaccgttcagggggcctcccctgctatccctcctcccatcctgtaccccccatttctggggcctcatcactgtggaagacggggatagtaagagataagtgggtgggaggcacggggaaggttttggagtagaaccaggggtgtgtatgaaggggggtgacaaggtccccctggggaggggaccaaccttgtctggtggatgagaaggcgtatttatttttcactgtacagtatttaaaaagagaataaaaaaatccaaatggc

SEQ ID NO: 370768 - DNA, 2274 bp, Homo sapiens
tgcgcagtaggcggcggtggcagggggaggtggaggctgtggagcggcagcggcagcagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctgctcgttggctgtggcagggccgccgtggggccggcccggctcccgccccccgcggctccccctccggctcctcctccggggagacgccgggggcctggcccggcccgcactcagactgctgctgcagccgccgccgggggagtcggaggcggtggcggcgccatgggcggcctggcctctgggggggatgtggagccgggactgcccgtcgaggtgcgcggctccaacggggccttctacaagggctttgtgaaggatgtccatgaagactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctgagagaagcctgctccaatgaaaacgtccataaagagttcaagaaagccctgggagccaactgcatctttctcaacatcacaaacagtgagctcttcattctgtcaaccacagaagcccctgtgaagcgagcatctctgctgggtgatatgcatttccgaagcctgcgcaccaaactgctacttatgtcccgcaatgaagaagctaccaagcacctagagacaagcaagcagttggcagcagccttccaagaggagttcacagtgcgagaggacctgatgggactggcaattgggactcacggtgccaacatccagcaggcccgaaaagtacctggggtgaccgccattgagttgggtgaagagacctgcactttccgcatctatggggagactcccgaggcttgccgacaggcccgaagctaccttgagttttctgaggactcagtgcaagtgcccaggaacctggttggtgagttggtggtgtgtatatacagttagaggtcagaatcaagattctcctacagtgattctgagcttttatcccaggattggcacctccctgtggactcccagtttcacaaggacagagaaacagtctgtaatgggagtgataaaaatgaaagaataaatttctagggattgtaacattttgtcctgtaaaaacacatcagaaacctagaagcaggagaatgaagtaaatggaatccatataaagaaaatgaggctggaagacggtgtatcagctttattcttatttccttaaaaaaaataaaaggctgaattcctcatttacctattccaggcaaagtgattggaaagaacgggaaagtgatccaggagattgtggataaatctggtgtggtgagggttcgagtggaaggtgataatgacaagaagaaccccagggaggaggtatgggtacggggcaagtgggcatagagattggtttccagaagtaaatgggattgtcctctgagggctgggattgttctttgagagggtggagtacggaaagttgtttaacactagtagatttagagcccagaatgatcccactgggcaggctcccctaggagactgggcggcgttaatccttccatttcattttcctttctgatccatcgtttctgctctctgttctctagggaatggttcccttcatttttgttggcacccgagagaacatcagcaatgcccaggctttgctggagtatcacctctcctacctgcaggtacccaggccgggagagaaaaatgctgggtgtgaaaagggaactaagactgctgtgggggtcagctcagggattttggttctctgtttgtctctccgtgtagaacagaaaacatctgtggaaatttggggctatagggttgggtcccagaattttccttgtttagccagtgtcttccttctccctgcattcctgagaggttagatatagagggacagtcagggtgcagaagc

SEQ ID NO: 370769 - DNA, 252 bp, Homo sapiens
gcggccgcctactactactactactactgctcgaattcaagcttctaacgatgtacggggacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370770 - DNA, 287 bp, Homo sapiens
ctctctgaactacaaaaaaatcaaatttctattcaaagtttctaatactagttttcccatttctaatgtggacactagaggccctgatgattttataaacaactatataacattagtgacatcggtgctccatacctgatagaaaagcagctacaattccttttttttttttttttttttgagacagagtttccccccataacctaattccagacccggggggacccctctatagagttaccctgtgcgggctttgcagcgcttgggcactgggccggctcgtttta

SEQ ID NO: 370771 - DNA, 4514 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370772 - DNA, 5280 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacactaaagtttgtcaaaaaatgaattcttaacttttctcccagagaaagggagacaaaaggagctttttaatacctaatctactttggaacataaccgtatagagtacgaaaaattttacgacttttttcctaccagattctgacagttcaccaaggtattataacatctccatttttgcgtatgaagacagtgacttgctccaagtaatccaggtagtaaatggctagaatttgaacactaaagccatgctctgctgcctgtaaggttttcaaaagaaatctgattaatcatttcgtatgtgattcacttgatcctcaaggcaacagggatgccattgccttgatttttcagatatggaaatagttctggagaattaatttgcctcatgtttgaagagctgaactcagtcttgattccaaatcctttaagtttgacctgaaaactttccttacctggatactttttgatattctcatatgattgcatatttggtataattggctttatttttggggggttaactttttaatttacctcaagttgcaatctgcttggggggaaaagctgaaacttaaaaccaatttaagtttctaaatttataaaacattgctaccttaggaatccactgacaacaaggcttaatgtgaacagaattatactggaacacaggcaaggaaccagaaaactgaattagaaactttctgaaaagtcacgtactgatttttgtactattatttgtaaagaaactacttactgtaatttctca

SEQ ID NO: 370773 - DNA, 4456 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaactgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370774 - DNA, 4460 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaactgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370775 - DNA, 4227 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaaatggacaaaaaaaaaaaaaaaaaaaacaaaaaaaaaaaaaaaaaaaaaaagaaaaagaaaaaaagagaaaaaaagaaagaacaaaaaaagagaaaagaaaaaaaaaaaagagggggggggtataaaattagacacgggcgggcgccgcgattaatcgccacacgccactagcccataacaaacggaggcacccccccaagcacgacagtatgaaaaagcacggccgggccgagcatccaaagacgaccggaagggaaacaaaggcgaggaagacataaggaaaaaccccccagtcgggggtagcaagacagacacccacgacgagaaaagacgccgagcagaaaaaacggggggtgaggcagaagcacagtcatgcgcggaagagagagcggacgctagaacaac

SEQ ID NO: 370776 - DNA, 3490 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccatgcccagcctcacaattccttacactacctctttttcattgttcctcatcactacaaaaaggagagcaggaagggtaagataggaaagcagcatttctttctcttctgaagtataattttaaaaagagattaaccctgaaaatcatggttttctatggtaatcaagctttgtacatcagaaaataaaacatcccattattaaacaaatatttattaaccggcccataaaaataatgaagttactc

SEQ ID NO: 370777 - DNA, 4436 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370778 - DNA, 2910 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagtgtggacagaccttcagtcacaagtcatcccttgtatccccatcatagacttccatcgtggacgagtaatcttaccaatc

SEQ ID NO: 370779 - DNA, 4682 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtggtaagccatgacaatttggtttaggtaataaggtaggtgaccaagttagtaggaaaacgattagacagaaagaactaaaagtctcaaaaacttacataactttcagatgttaaagctgccattttagtgtcacaaaagtaatattttttccccctcatccctatttagccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370780 - DNA, 4574 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggataccacactctacaggtttatctccagtctcactggccactccttttcagtctcttttgctgtttcttctcatctccccaatgtctaaacagtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370781 - DNA, 4348 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagattccaattatgccagccagtccacaaaaaggtcatgccgtgaacctgctagatgtgccagttcctgttgcacgaaaactatctattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370782 - DNA, 3048 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatttttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccaccattaaagaacctgcttgtgtagtggtatctatctcttgtctgtgtatgttcttaatgttccttttatctaacctgtggaaga

SEQ ID NO: 370783 - DNA, 1050 bp, Homo sapiens
  misc_feature (12)..(12): n is a, c, g, or t
  misc_feature (24)..(24): n is a, c, g, or t
  misc_feature (44)..(44): n is a, c, g, or t
aaaggcctatantttgaaaactgngccttaatgatggcagtgantttttaagtgtggtaacaaacgttttgggagcatgtaccctctgtcaagatggtactagtaacagattcaaagtagtacccatatcgtatcagactgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370784 - DNA, 630 bp, Homo sapiens
  misc_feature (23)..(23): n is a, c, g, or t
aaacctcatcacctaccccccanaaagccagccttaggtctgtaaagtctgaaggagtatgtgtatcctatctgggtgttgttttaatttttttttttgagacggagtttcgctcttgttgccaaggctggagtgcaatggcacgatctcagctcaccacaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370785 - DNA, 302 bp, Homo sapiens
tttcctttaaaataattctgtatgctggtttgttaatatagtttattgaattaacaaaaaatgtgttaagaaactcattttgctcttgtatatattctgttttcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggtaaatttcagatttgagataattattttacagctcttcatttttgat

SEQ ID NO: 370786 - DNA, 480 bp, Homo sapiens
atataataagagttctaagttttattttctcagggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggtaacggagagaaatgtaacaggtttcacatgaactagaaaaggacatgaagtggtggtttcactgggtggaaggaaatgtataagatgggatacaaggtaaaatctgtagttcccttacctgaaagtgatttgaaataggattcttaaatgtagtctccaaattgaattcagtatttctgtgatcattaagtaaaagaaaatgactgttagcctggcatggtggcttctacatgtagtctcagctacttgggaggctaaggtgggaggatggcttagtgagactatgact

SEQ ID NO: 370787 - DNA, 3450 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaccagtagacgctcctctactctttgagacatcactggcctataataaatgggttaatttatgt

SEQ ID NO: 370788 - DNA, 4564 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgacaaaaaaaaggaagagtgggagggagaggggggggggaaaaaaaagtcgacg

SEQ ID NO: 370789 - DNA, 4403 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370790 - DNA, 4481 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370791 - DNA, 2938 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcattcactgtcagcctgcagctgtcttacagcctccgatgccttgctaacaaacctgcaggcca

SEQ ID NO: 370792 - DNA, 5538 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatttttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370793 - DNA, 4520 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatgaccctgctacatggaaaaactcaagacacctttctaaaggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaagaaaaacacccaaggctgggcgtggtggcacacgcctgtaatcccagcactttgggaggccgaggcaggtggatcacctgaggttgggagttggagaccagcttgaccaacatggagaaaccccgtctctactaaaaatacaaaattggccgggcgtggtggcgcatgcctgtaatcccagctactcgggagggtgaggcaggagaattgcttgaccctgggaggtggaggttgtggtgagctaagatcgtgccattgcactccagccttggcaacaagagcgaaactccgtctcaaaaaaaaaaaataaaacaacacccagatagatacacatactccttcagacttacagacctaagctgcatttatggggtagtgatgaggtttagaacatatacatattttgttaaaattccccagatgattcttggtatgaacgactatattataaattttaagatgtacttagaaatccttaagacatctagccccgtctctaatagacaacacatttatattgcagatattacttttttttcagtttatgaccaggtatttatgaaggactattggcagggaaaatatgaatatgttaactttagcttatggcatcaatttactaaggaacaacaggctcaccaactgatgtcaaacataaaaacccccacatcagtctgatacgatatggtactactttgaatctgttactagtaccatcttgacagaggatacatgctcccaaaacgtttgttaccacacttaaaaatcactgccatcattaagcatcagtttcaaaattatagccattcatgatttactttttccagatgactatcattattctagtcctttgaatttgtaaggggaaaaaaaacaaaaacaaaaacttacgatgcacttttctccagcacatcagatttcaaattgaaaattaaagacatgctatggtaatgcacttgctagtactacacactttgtacaacaaaaaacagaggcaagaaacaacggaaagagaaaagccttcctttgttggcccttaaactgagtcaagatctgaaatgtagagatgatctctgacgatacctgtatgttcttattgtgtaaataaaattgctggtatgaaatgaca

SEQ ID NO: 370794 - DNA, 2532 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggcgatcggtgcctttcccttagggagggtaagttatgatctagctactgactactgcagtcagtcgtcagttgcgg

SEQ ID NO: 370795 - DNA, 2399 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgctagaatttgttatattttccatgagacttttgggcgaaccttagaatctgttgatccacttggtggccttaacactattgacattttgactgccattagaaatgctactggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggaattgttacgatttcctaaacttcatgatgccatagttgaagtggtgacttgtcttcttcgtaaaaggttgcctgttacaaatgaaatggtccataacttagtggcaattgaactggcttatatcaacacaaaacatccagactttgctgatgcttgtgggctaatgaacaataatatagaggaacaaaggagaaacaggctagccagagaattaccttcagctgtatcacgagacaagtcttctaaagttccaagtgctttggcacctgcctcccaggagccctcccccgctgcttctgctgaggctgatggcaaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtgccagttcctgttgcacgaaaactatctgctcgggaacagcgagattgtgaggttattgaacgactcattaaatcatattttctcattgtcagaaagaatattcaagacagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaagttgtaactggagctgttgtaactggagctgttgtaactggagctgttgtaactggagctgttgtaactggagctgttgtaactgagctgttgtaactggagctgttgtaact

SEQ ID NO: 370796 - DNA, 1543 bp, Homo sapiens
agcgggcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggggtggaagcagaagaatggggtaaatttcttcacaccaaaaataagctttacacggattttgatgaaattcgacaagaaattgaaaatgaaacagaaagaatttcaggaaataataagggagtaagccctgaaccaattcatcttaagattttttcacccaacgttgtcaatttgacacttgtggatttgccaggaatgaccaaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctatgcggtggtgtagaaattgaccgtccaatttctacacaagtatattttaaaaggaaagcctagtgtcctgttcataattatcataatggtctatttttttaagcaacaggctcctactatatggccctggctacacttcaactcctagactcaagcaattctctcatctcagtctcctgagtagttgggacaccactgtgccaattcccattattagaagaaattatgttcatctccacagtatacactcttatctgtagtgagtgtagaaatgaacggtacgagccgaatacgaac

SEQ ID NO: 370797 - DNA, 907 bp, Homo sapiens
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggaca

SEQ ID NO: 370798 - DNA, 902 bp, Homo sapiens
ggttgctaagcccccactgccgggggaggcgggtgatgggccggcccagggcctgagaggggaagggcagggtgcacaggagacacggcaggacgggaccatgggctgctgctcctcgagtgacccccgcagagaagacgatctgagagccagagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggaca

SEQ ID NO: 370799 - DNA, 2355 bp, Homo sapiens
  misc_feature (2286)..(2286): n is a, c, g, or t
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcacctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttataaaaggtgaatctattgaaagaagaacatnaaagaaataaacaggagttcagcggagtagcagaagacaaggcatgtagggggagccattctgtcccag

SEQ ID NO: 370800 - DNA, 2257 bp, Homo sapiens
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggacatttggttttactgctttttctctgcttccagttggagttgattcatgtgcttgtgcctacctggccgcaagtccccagcccctcaaccctccgttcctcctcagcctccctttgccagccacccctcctctagctctggtgggaggcccggggcccttcctcgcacagggcatgcctggcctgaggacccggcgctgagtggcggggcccctgctccgaggggctcatgttcaggcagaaccggtcccagcctgggctcctctgcatcttgctctgtggccttggccctgacccccatcgctctgagcatatgttccatgcctggcccttgccggggcctggactgcacaggcagcaaggtcatggtctgagtggggcttcctgggcagttggggcggcccacgccagctggcccagtgggtagtgaattggcttccttgacgcgagaggctctgagggtctgaaaagggcatctcaatggcatgggtgggtggggagtcagtcatgtcactgaaattgaatgggggaggcccaatgaggtggctcatgcctgtaatcccagcactttgggaagctgaggcaggaggatcacctgaggtcaggagttcgagagcagcctggccaacatggcaaaaccccttatttactaaaaatacaaaaattagccgggcatggtggcatgtgcctgtattcccagctactcatgaggctgaggcaggagaatggcgtgaacccgggaggtggagcttgcaatgagccaagattgcgccactgcactccagcctgggtgacagagcaagactccgtctcaaaaaaaaaaaaaaaaaaaaagaaattgaattgggggagtcatggtcaggggtgagacctgaaggacctccccctgtgtggccctggacacagcccaccctctgtgagccgtttccaattctaaaacagactcaatgtccccctcacccccacctcaaggtcaggatgcgaacacactgagtgaggagtggacgctgtccattgccacggccatgagggctggagaccagaacagcatggcccgaagcgtgcggggccccggatgacttggggacaccccagaatcccctggggagaacccttcctgcgcgctttcattttttgacctcatcactgagaaaggctcaatttggtgctcacgtgtccttaacacctgatctggcccaagctgggctccctttaagccaagagagcctcttgtggaccccgcctgcccgaatgaaatccgaacagttggggctgttcatggcaagtggggctggtttttcatttccattggttatttaaagtttcctttaaaataaacgattttaagttata

SEQ ID NO: 370801 - DNA, 857 bp, Homo sapiens
gggaacgccggctcccggcatgccgcgcgctgacagccttataaatagtcgcctttgccggccgccgcgaggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctccatttgcttctttctcttttcctgctccactttatcttccagctttctgattttctcttcatactcctctcttatccgcgctttctctctctccagctccactctgtggagttcttgcattgcttgtgtttgcttctggatctcctcctccgc

SEQ ID NO: 370802 - DNA, 1048 bp, Homo sapiens
gggccggacgaatgtgtcacctacatccagaatgagcacagtcgcaagggcaaccaccaccgcttcatcaccgagaaaagggtcttctcatcgtgggcccagctgaataaacacacctacgctccggcttcgtgtcctgtgtcgcctgggtcgagcacagccttctggtccagcgctgcatgcggcctcaggaccacgtcttccggttgggggctcccagtaaagcgatcctcagcttcttcagcagccagtggccagtgagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggaca

SEQ ID NO: 370803 - DNA, 921 bp, Homo sapiens
ttctgggagtttcgaggggagcagctctgcagttgtgtggccgctgtttatgtccctcggtgccatcctcactgtcccagcccctccagcgggaacccaggtggatgggagggggctactgcccttctgtgacagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagcgacggattggacagcccacactgctgctgtatgtggacgcaggccctgagaccatgacccagcggctcttgaaacgtggagagaccagcgggcgtgtggacgacaatgaggagaccatcaaaaagcggctggagacctattacaaggccacagaacccgtcatcgccttctatgagaaacgtggcattgtgcgcaaggtcaacgctgagggctccgtggacagtgtcttctcccaggtctgcacccacctggacgccctaaagtagcaacgctggagccgcttccccagctcagagccccgccccaccccgtcctgattagaggtcctcctggcctgagcgcagcgcctccaccctgccctgctgagcacagacggaggaagccgcttatcctgttttcatggacagctgagcactaaaggaatttctaaggaca

SEQ ID NO: 370804 - DNA, 598 bp, Homo sapiens
gggccggacgaatgtgtcacctacatccagaatgagcacagtcgcaagggcaaccaccaccgcttcatcaccgagaaaagggtcttctcatcgtgggcccagctgaataaacacacctacgctccggcttcgtgtcctgtgtcgcctgggtcgagcacagccttctggtccagcgctgcatgcggcctcaggaccacgtcttccggttgggggctcccagtaaagcgatcctcagcttcttcagcagccagtggccagtgaggtgtgtatttttgcatcttgagtggagacctgggggctctggggatggtgggggcgtgcggagccaggcccgtctggcttttcctgtccccacctcaccctgcctgtgtgaccacgggcaagtcacttcgcctctgagagccccaattccttcaagggcaaaaggggaccagacactgccctcaaggagctcaggttccaggaggggaggagccccgtggtacactaggaagaattcccacagaagctgggaaaagagtttgagcagtgaatgcagaaggggtgaggggaaagacatcccaggccacagagccagaggtctctcagctccttaagc

SEQ ID NO: 370805 - DNA, 3440 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370806 - DNA, 643 bp, Homo sapiens
tgagcaaaaataggcagagggctgggtaatcggacgaggtggtacatgaggggactgttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaaaaaaaaaaaaaaaaaaaaaaaaaaaaaaaaaaaaaaaaaaaaaaaaaaaaaaaaaaagaaaaaaaaagaaaaaaaaacgagagaagggaggagaagaaaaagagaaaaaaggggggggggggcccaaagacccaccgcaggcggggtcgttcacaaaggggccgcccccatatagtgtggaaagaggagagcgagcgccagcagcggtagggagcgtaatatataaaaagcagcgcgcggccgggtggacaagacaacaagcgtgagggctgaaggacgaaaaaaactcgctaagttgtgtgtaggaggcaacaaacaacacactcgtagggcgacgacacaacaagttgtggggcgcacagcgcgcgaaacg

SEQ ID NO: 370807 - DNA, 3441 bp, Homo sapiens
aacggagattacgaggcgtcccctgggttttaatttagtcacgagggcggcgttacagtttacttaggttggccattggctgtacagcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370808 - DNA, 3372 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370809 - DNA, 4973 bp, Homo sapiens
  misc_feature (1686)..(1686): n is a, c, g, or t
  misc_feature (2128)..(2128): n is a, c, g, or t
  misc_feature (2228)..(2228): n is a, c, g, or t
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgtgagttccaaaggcggggtgctggggagaggcagctccgtccatctctttttgttctaatgggtaaactgcctgcatcacagctccccttcatccccccattccgtttcctctgttctaatggcagctggccgtttcatatgcttaaacttgaccaaaatggtttgctttgttatttccccagggcttgaccctatagggactagcattatgatctcgttctcagctttctgatttagaaatatctgagtggaagttggagggggaggctgcttgggtctcctagctgtgtgcatcatcccgggaacagagaactccactgcatgattggctctgatggagacagtgccagatgctaccccttattttgttccccagtgaggttttttgtttgtttgtttgtttgttttttgctttttcagttattttgagagtctcactgtgttgcccaggttggtttcaaactcctggggtcaagcaaccctctcccctcngcctcctgaggacctgggactataggcgcacaccatcacgcccagctggatttggcttttaagtacagtgggaagccattgaaggcttttgttgcacacagctgagtatacatgcctggcccaggactgagggatgttttgaagcctgagatgcataaaatgttgagactgtgaggacttcaccttctagataaggaagcagataccagggaggaggttagacttgccagggtgagtgggatagtgtggggcagggctgaaatagactttgagatttaaaaagactaggatttgaaccctgggtaatgaattatgtgatttggataagttcttaaactgtgttcaaggaataagaaatatttcttagggttttgtaacctaataagtttgggaactactgggctaaacagagttacatctgtttcactttcgggcttctcanattgtgtaatatgctaatggatgttaccatccagaaggaacatgcagtgtttcctaaacttaaaaccacaattagccaggtgtggtggcatgcacctatngtcccagttacttggggggccgaggtgggaggatcgcttgagcctggaagatcgagactagtgagccatcatcatgccactgcacttcagcctgggtgacagagtgagattctgtctcaaaaaaaccccacaaaaccctagaacatacagcactgcctgcgtctccattttctcatcagtaaataagaaaaacacagcctgggccacatagcaagacctggtctctacaaaaaattttaaaaatgagccaggcatggtggtacacgcctgtagtcctagctccttaggaggctgtggcaggagaactgcttgagcctaggagatggaggctgatgtgagctgtgattgagtttgctgcgaggtggaatgagatgaaggggtatggaaagtgttacacccagtgcctagctcatgacagatgcccagtaaatggtgggtcccctccccatctaaggaaaaactgacaagaatttttgactcttctctgctctccacaggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370810 - DNA, 3507 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatgggaccaggcctttccagtaattagactgctcaagtctgctatcaagggaactatcagcttgctcagggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370811 - DNA, 6850 bp, Homo sapiens
  misc_feature (1686)..(1686): n is a, c, g, or t
  misc_feature (2128)..(2128): n is a, c, g, or t
  misc_feature (2228)..(2228): n is a, c, g, or t
  misc_feature (5093)..(5093): n is a, c, g, or t
  misc_feature (5148)..(5148): n is a, c, g, or t
  misc_feature (5155)..(5155): n is a, c, g, or t
  misc_feature (5181)..(5181): n is a, c, g, or t
  misc_feature (5215)..(5215): n is a, c, g, or t
  misc_feature (5243)..(5243): n is a, c, g, or t
  misc_feature (5684)..(5684): n is a, c, g, or t
  misc_feature (5690)..(5690): n is a, c, g, or t
  misc_feature (5697)..(5698): n is a, c, g, or t
  misc_feature (6616)..(6616): n is a, c, g, or t
  misc_feature (6784)..(6784): n is a, c, g, or t
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgtgagttccaaaggcggggtgctggggagaggcagctccgtccatctctttttgttctaatgggtaaactgcctgcatcacagctccccttcatccccccattccgtttcctctgttctaatggcagctggccgtttcatatgcttaaacttgaccaaaatggtttgctttgttatttccccagggcttgaccctatagggactagcattatgatctcgttctcagctttctgatttagaaatatctgagtggaagttggagggggaggctgcttgggtctcctagctgtgtgcatcatcccgggaacagagaactccactgcatgattggctctgatggagacagtgccagatgctaccccttattttgttccccagtgaggttttttgtttgtttgtttgtttgttttttgctttttcagttattttgagagtctcactgtgttgcccaggttggtttcaaactcctggggtcaagcaaccctctcccctcngcctcctgaggacctgggactataggcgcacaccatcacgcccagctggatttggcttttaagtacagtgggaagccattgaaggcttttgttgcacacagctgagtatacatgcctggcccaggactgagggatgttttgaagcctgagatgcataaaatgttgagactgtgaggacttcaccttctagataaggaagcagataccagggaggaggttagacttgccagggtgagtgggatagtgtggggcagggctgaaatagactttgagatttaaaaagactaggatttgaaccctgggtaatgaattatgtgatttggataagttcttaaactgtgttcaaggaataagaaatatttcttagggttttgtaacctaataagtttgggaactactgggctaaacagagttacatctgtttcactttcgggcttctcanattgtgtaatatgctaatggatgttaccatccagaaggaacatgcagtgtttcctaaacttaaaaccacaattagccaggtgtggtggcatgcacctatngtcccagttacttggggggccgaggtgggaggatcgcttgagcctggaagatcgagactagtgagccatcatcatgccactgcacttcagcctgggtgacagagtgagattctgtctcaaaaaaaccccacaaaaccctagaacatacagcactgcctgcgtctccattttctcatcagtaaataagaaaaacacagcctgggccacatagcaagacctggtctctacaaaaaattttaaaaatgagccaggcatggtggtacacgcctgtagtcctagctccttaggaggctgtggcaggagaactgcttgagcctaggagatggaggctgatgtgagctgtgattgagtttgctgcgaggtggaatgagatgaaggggtatggaaagtgttacacccagtgcctagctcatgacagatgcccagtaaatggtgggtcccctccccatctaaggaaaaactgacaagaatttttgactcttctctgctctccacaggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctacctttgagttatcttttttttttttttttttttttgagacaaagtctcactctgttgccaaggctggagtgcagtggcactatctcagctcactgcaacctccgcagccagactcaagtnatcctcccacctcagcctcccaattagctgggactgcaggcgtgcatcaccatgnctggctnatttttgtagagatgaggtttcaccntgttgcacaagctggtcttgaaatcctgacctcnggtggtctgcctgcctcggcctcccaangttggaattaacaggcgtgagccaccacgcccagccaagggttttaatcttgcagggatttcaacatttggggtggaacttaattatttaaaaaatagagacagattcttgctatgatacccaggatggtcttgaactcctgggcacaagtgatcctcctgcttcagcctctcaaagtgttggagttacaggcatgagccactgctccccaccagggatgcaaattacttgatactcctctccagaaggtggggtcctgtgcccctcctgaacccaagtgtgctctgttactactttgaccagatgtgactctgccatttctgtgcctaggcttttaaagatggtcacttctccatttcctgtgcctggaacattctctgggagccttgacaccacatttgaagttgcctattggggccagcatggtggctcacgcctgtnatcccngcacttnngaaggccgaggcaggcagatcgcatgaaatcaggagtttgagaccagcctaaccaacgtggtaaaaccctgtctctactaaaaattacaaaaattagaggggcgcggtggtgggcgcttgtaatcccagctattcaggaggctgaggcaggagaatcacttgaacccgggaggcggagtttgcagtgaggtgaaatcacgccactgcactccagcctgtgcaacagagcgaggctctgtctcaaaagaaaaaaaatagttgactgtcggtttggcatggtggctcatgcctcttgtcccagcactttgggatgctgaggcaggaagattactggagctcaggagttcgagaccagcttgggcaatatagtgaagccctatctttacaaaaaacgaaaaattagctactcaggagcctgaaatggaggatcatttgtgcccaggaggcagaggtcgcagtgagctgtgatcatgccactatactccatcctgggcaacacagtgagacggcagaaaaaaaaaaatagttgactattgagtctcatatctgattgcccacctgacatctcccctgagtggcctaatgggcatctcaccacggcccacagagaactgatctactcgattttccctaagctggcccctctcctgcagtctacccatgtcagtcaatggcaacaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgcnacaaaaacgcgctcgcgccggcgccgaaccgcaactcccggcgacccccgcgctcccgggtggcaagatggtggcgcgcaggacgaagctcgcggcgcgggacccggaggacggtatcccgagcccaccgtgctacgcaggtgaggggatccggaacgcgagaccggnggcggccagcatcgccgggaggtgtttgggggctggcggcggccgggggtccccaggagcggccgc

SEQ ID NO: 370812 - DNA, 3825 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaaaaaaaaaaaaaaaaaaaaaaaaaaaaaaaaaaaaaaaaaaaaaaaaaaaaaaaaaaagaaaaaaaaagaaaaaaaaacgagagaagggaggagaagaaaaagagaaaaaaggggggggggggcccaaagacccaccgcaggcggggtcgttcacaaaggggccgcccccatatagtgtggaaagaggagagcgagcgccagcagcggtagggagcgtaatatataaaaagcagcgcgcggccgggtggacaagacaacaagcgtgagggctgaaggacgaaaaaaactcgctaagttgtgtgtaggaggcaacaaacaacacactcgtagggcgacgacacaacaagttgtggggcgcacagcgcgcgaaacg

SEQ ID NO: 370813 - DNA, 3159 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370814 - DNA, 3373 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370815 - DNA, 3288 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370816 - DNA, 1871 bp, Homo sapiens
cttaccggttcgcatgtgtcccatctcattgccaaggtagcttgtgttgttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370817 - DNA, 2781 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattatttccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370818 - DNA, 1428 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcagggtggctctgtttccccaaggcaaagcttatgaccaatgggccatcggactggagacccctgattgtgggaagggttgccagggataaagagcttcctcactgga

SEQ ID NO: 370819 - DNA, 1458 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgcttgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370820 - DNA, 1077 bp, Homo sapiens
cagtcagttgtaaggtctcaaaacctggacactttggaacgtagcaatcggatgaacgatcttggaaacatctctcgggactcctgggctgtgtacttgaaatagttctggggatgggccaggacatcaaacagagccttgataagtttcttatccttaagtatttcctgatggttctcagatgcatagagcctgccatctcgaactatgtcttcaatgagttcctggtagtcctcatcatatgtcacgtatgggacctggaaccctctagcgctgttcccttcattggacttgaactgaatccacagcttctttgacctggaggtgaaggcgatggggcgttcgtaggtctggcaggtttcatatgttgtcacagaattggatgaagaggttttccgcatcaccagatagtccccacagtcgtcctctatgggcaggaagatctcagggaccacgatcaggatgcggcgcttgggttgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370821 - DNA, 1086 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370822 - DNA, 1153 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatgggaccaggcctttccagtaattagactgctcaagtctgctatcaagggaactatcagcttgctcagggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370823 - DNA, 1018 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggtgagttgtggcttttgtcatgaattcccagaaagctagtaacaaaggtagatttagaggcaaggtgccaggagtgactgggcaaaaatactatcctctcaagtgttggcataatacagactttgctccttacagaggctttaagtacgttatagccaaggaactatacaaggaaggaaaggtattatctcagttctaaaaaaaaagaaaaaggaggcccatagaaatttggtgactttcccaggtgagatactggtggaagaaagagagaggaaaggacaaaagatttattgagcacatgctatgtggcaggcccttaatatctgtgaccttacaagtcctcactccacccccaggcccagtgggatttggcccctagtccaaggccctggccacccttcacagctgccaccacagagggaaaggaaacaatgtcatttaaccttcatagcagctttggtaat

SEQ ID NO: 370824 - DNA, 445 bp, Homo sapiens
acaacaaccggtgtctggacggtaagttagggagaaagcagtcccctgaccctcccactcatctctacttgctgtcaggtagcaggccttccaggggaagtctctgtgagatgggtggaacccatctctggggcctcgtctgcaccaggaactgccgtgcagtctctgagtagtcctgagctgtgggttacacagggccctggattttcacccagcccttaagcttttgagcccagcaaaaaggaaaacagcatttctccatggatggttctcttaaggggtcttgccaggggagccaagaggcacagctgttgcctcccagatgttgatctgtttagtgctagggcagaagttcctcccagccctggagttttgtctgaatgttgacacctgggtgagagctgctcctggtgggtaaacaacagactttattgacttgaggttc

SEQ ID NO: 370825 - DNA, 297 bp, Homo sapiens
tgtatcaagttcagtaacccccttcttctagagaatgcatgtggaccctgtggggtggattctgaccactgagtgtttccaggttccacagcagaaagccatggcaccacttcatccccatcctgccggaatgagaatcaatgttgtcaataaccaccaggccaaacaggtagagtgagtgagtgagagagagagagagaatctgtgtgtacatagcgaacatgtaggtgtgcacgtgttttgatgaggcctacttgggtggatggactgaggcttgctcagttggtagttcccagt

SEQ ID NO: 370826 - DNA, 1464 bp, Homo sapiens
ccaggaaagatgtagcgagtgccgtcactcgggtgtaaatttcagtgacgcggggcaggagtgtcaggatcatatacctgggccgctcgcattacagaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggtatggcatttcatgttttcttacactgcgtgtctgatcaggcaggtgggagaggtcgtgttgaatagaacctgttgttttttttgttttgagacgacatctcgctcttctcccccaggctgctggagtgcaatggcgcaatcttggctcactgcaacctccgtctcctgggttcaagctattatcctgcctcagcctccctagtagctgggattacaggcgcctgccgccacgcccagctaatttttgtatttttagtagagatgaggtttcaccatgttggccaggctggtctcaaactcctgacctcaggtgatccgcacgcctcggcctcccaaggtgctgggattacaggcgtaagccactgcgcccggcgtgaatagagcctttcaatgcagaaatatttctttgtttgggccgtaagattttcagagctggaactagtccattcccttagttttataaacgctgagacactggggtgccttctgatttgttcaaggtcccacagcaagtgaagtacagggctgcagctcctaggtgctgtgtttgagacactatagggaaagtgtgagtgatcccacagtggggagtctgtgttctttccttggtggctggccattctgcatgcttcgtaaccctttgtggtcagcagctctggcgctgctcttggagtctggattccgttggttaacattagcaggaatacatctcacctgatctgtgggctctaccaggtgcagcctgcatgcagggaaagcttgcta

SEQ ID NO: 370827 - DNA, 3351 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370828 - DNA, 3275 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370829 - DNA, 3171 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370830 - DNA, 4530 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaacagaaacacaaaaacaacaatgaaaggagccgcgcctcgcatcaagaatactccgcacgcgagaggccagaacgacctacccgcgcgctgccaggcagcatcgcctgtcatcacacggggaggaccacgaacatcatgaagagccaagtaatatcaacacatgatgcacacgagcacacgctgcagaccacaagcgtccgacaagtgtgcgaaatacctgtgcggacgcagctggagaaccacctgcgcgtccaatgacacaccccgtcaagccatccacagacgcgggctcgaccaacacagtgggagaaacaccgacacgtgcacaagcgaattccacaatgccccaagacgcgaccaacaccattaacacaacgtgcaaccacgaggcagaaaaaacgtgcgtgtaaaacatctcccaagcgatgccaattcatgactcggcgccctggcccaatcccacacaccaacatccttggcgctcatcaaaccgcgcgaccatacaaaactactgatccagctgaacacccgaaagccctgttcacacagccccggcggcggcactacacagcggcagaaaaagaagggaccaaacgccaaggcacaccaggaatccaccgcgcaatagcccctgacatcacagagaagaaccaggcacgacatggcggaccgcaaagaagccagcagcgggtagagacaggcgatcacggccagggcacaaaccggaagagaaggaacaaaacaggcacgcgacggccgagagagccaaaggccgggacacacacaagaatgagagcaataacatgcgacatcacgaacacaaagcacaaagcacatagacaatgcactaggaccaaccaccaacagcggagaatcgagcccaataccgacagcctggacgtcacagacgaacaccaagtcacacaacaacgaacgaggtcggaaatttgcgagaggtaggggacacactgcgaagacatgcaaacagacacacacacaactcgcgccacaccgcacgacacttacgccgggacaatcaccgcgcatatagcgctaagaacgcatccacacccgccca

SEQ ID NO: 370831 - DNA, 3331 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370832 - DNA, 4378 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcctaaaaaaaaaaaaacagaaacacaaaaacaacaatgaaaggagccgcgcctcgcatcaagaatactccgcacgcgagaggccagaacgacctacccgcgcgctgccaggcagcatcgcctgtcatcacacggggaggaccacgaacatcatgaagagccaagtaatatcaacacatgatgcacacgagcacacgctgcagaccacaagcgtccgacaagtgtgcgaaatacctgtgcggacgcagctggagaaccacctgcgcgtccaatgacacaccccgtcaagccatccacagacgcgggctcgaccaacacagtgggagaaacaccgacacgtgcacaagcgaattccacaatgccccaagacgcgaccaacaccattaacacaacgtgcaaccacgaggcagaaaaaacgtgcgtgtaaaacatctcccaagcgatgccaattcatgactcggcgccctggcccaatcccacacaccaacatccttggcgctcatcaaaccgcgcgaccatacaaaactactgatccagctgaacacccgaaagccctgttcacacagccccggcggcggcactacacagcggcagaaaaagaagggaccaaacgccaaggcacaccaggaatccaccgcgcaatagcccctgacatcacagagaagaaccaggcacgacatggcggaccgcaaagaagccagcagcgggtagagacaggcgatcacggccagggcacaaaccggaagagaaggaacaaaacaggcacgcgacggccgagagagccaaaggccgggacacacacaagaatgagagcaataacatgcgacatcacgaacacaaagcacaaagcacatagacaatgcactaggaccaaccaccaacagcggagaatcgagcccaataccgacagcctggacgtcacagacgaacaccaagtcacacaacaacgaacgaggtcggaaatttgcgagaggtaggggacacactgcgaagacatgcaaacagacacacacacaactcgcgccacaccgcacgacacttacgccgggacaatcaccgcgcatatagcgctaagaacgcatccacacccgccca

SEQ ID NO: 370833 - DNA, 1513 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactgga

SEQ ID NO: 370834 - DNA, 1191 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 370835 - DNA, 1561 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatgggaccaggcctttccagtaattagactgctcaagtctgctatcaagggaactatcagcttgctcagtgagtctctatccctatttgataccctaattgaataaatgccatatttatactcatgcgtcttgtaccctgtgagatgggtactgttgattaccctcgttgatggatgagggacaggcatggagaggtgaaataagcctgttcaacatcacccagctgatgagaagcagtggatctaggaatggagcccgagcagtctcgctctcagggccctgtgtggagtcactgtgctgtcccagctctggagacgcagaattccacatgaggaatgtggaattcagcatggggatgacgctgcttcacccagacttggaggagcgtggtgaattgcccgtgcccatgctctgatgtgcctctctggccgctgcgttcctcctttctccctgccctgggtcagtgcctgtaaacactgccctaaatcagcagggcccccgtcacttctgctttatgcacctttttcctcagacacattaatacaggggagttttgtttccaagggaccacatccagatggaggggctgtttttggtgatctgcactgccaaatgcccgagtgtccctgacagtcggagctgatgaggccaaggctgtgtgtggttcctctggatggccagaagaggaaccaaaacactgaattctgggccttcttaagagtggtgatcagcacattgtgatagaagcatatctgggaatgaacttggcctcaagcttttggccttttaatttttttttttgtaagcaaaagcagctttattaaga

SEQ ID NO: 370836 - DNA, 1504 bp, Homo sapiens
cgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggtatggcatttcatgttttcttacactgcgtgtctgatcaggcaggtgggagaggtcgtgttgaatagaacctgttgttttttttgttttgagacgacatctcgctcttctcccccaggctgctggagtgcaatggcgcaatcttggctcactgcaacctccgtctcctgggttcaagctattatcctgcctcagcctccctagtagctgggattacaggcgcctgccgccacgcccagctaatttttgtatttttagtagagatgaggtttcaccatgttggccaggctggtctcaaactcctgacctcaggtgatccgcacgcctcggcctcccaaggtgctgggattacaggcgtaagccactgcgcccggcgtgaatagagcctttcaatgcagaaatatttctttgtttgggccgtaagattttcagagctggaactagtccattcccttagttttataaacgctgagacactggggtgccttctgatttgttcaaggtcccacagcaagtgaagtacagggctgcagctcctaggtgctgtgtttgagacactatagggaaagtgtgagtgatcccacagtggggagtctgtgttctttccttggtggctggccattctgcatgcttcgtaaccctttgtggtcagcagctctggcgctgctcttggagtctggattccgttggttaacattagcaggaatacatctcacctgatctgtgggctctaccaggtgcagcctgcatgcagggaaagcttgcta

SEQ ID NO: 370837 - DNA, 510 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370838 - DNA, 2165 bp, Homo sapiens
ttttttttaatttttgtatttttggtagagacggggttttgccatgttgggccaggctcgaactcctggcctcaagtgatcctccctccgtggccttccagggtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtggctgggactgcaggctcccaacaccacgcccagctaatttttatgtatttttagtagagatggggtttcaccgtgttggccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctcccgttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaaggaagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagacaagcctgggtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctggatgctttggagccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370839 - DNA, 1146 bp, Homo sapiens
cggacgcgtgggaaagattataagataaactctaatccttaattgaatttatgtttatatcaggatccgtggcagggtcaagcgatagtcgtgtaccagcggatgcagatataaacataaattcaattaaagattataagataaactctaatccttatttttcattaatggttagagttaattccgatggtggcaaatacccagagttatctctggagaaactcctagaccgggaagaacagagatctcatagcttgatattgactgccttggacggaggggacccaccaagaagtgccaccgctcacatagaaatttctgtcaaggataccaatgataaccccccggttttcagcagagacgaatatagaattagtcttagtgaaaatctgccccctgggtcccctgtgttgcaagtgacagccactgaccaggatgagggggtcaatgctgagataaactactacttccgaagcactgcccagagcacaaaacatatgttctcattggatgagaaaacaggtatgattaagaataaccagtcatttgattttgaagatgtagaaaggtacaccatggaagtggaagcgaaggacggaggtggtctctctacccagtgtaaagtaatcatagaaatccttgatgaaaacgacaacagcccagaaataatcatcacttctctctctgatcagattttggagaattcacctccaggaatggttgttgccctcttcaaaacacgggatctggatttcggaggaaatggagaagtcaggtgtaatatagaaacagacattccattcaagatttattcttcttcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370840 - DNA, 491 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370841 - DNA, 476 bp, Homo sapiens
tgagggccaggcgcggtggttcactcctgtaatcccagcactttgggaggctgaggcgagcggatcaggaggtcagaagttcaagaccagcctggccagcaggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370842 - DNA, 818 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaaaaaaaaaaaaaaaaaaaaaaaaaaaaaaaaaaaaaggggggggttttttggggggggggggaaaaagggtgtaataaagagaagcacatagacacacagctgactccaccaacaccacatttatataaaaaagggggagaagacgcgggggcccacaagaggagggccggtaattatagaaaaagcgcggtcccccgttttctctcctcctcatctacgtcgaaatagaaaggtgacaacgaccatcaagctaaagcccaacgaaaagcacagcacacacagaaaagcccagaaaaaaacat

SEQ ID NO: 370843 - DNA, 838 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaagaaaaattttgttggggggatttgggccttggagagaaggttttgtgagagacccttgtggtgtggggggggggggccctgtgggtcagcgtggacacggggcacaagaggggttcccccagaggtgatattgcgcgggccaatggaaaaagggggtggtgggggaattttttaccgcattatataaaaaagcgcgggggggggaaaaaccggggaggtgttttgtgaaaaaattcccgagatgggaggagttcggagaggggcacatagcggggatttctatcacacggggaggattcacagagggaagtccgaattttaaaatttg

SEQ ID NO: 370844 - DNA, 777 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaccaaaaataaacagaacgaaacacaaaataaaaatagctttcaaaacaaaatcaatatgctaaaaaaaaacagtggggcgcctctggccccagcgttttagaatctggaacattttttattatgggcccatattggggctttttggccaaattcccttttatggggcgcctttaaaattacggtgcccggtttttaaaagggggtctgggaaaacccggggttcccccaattaagcgttggaaccccttttccagatgggac

SEQ ID NO: 370845 - DNA, 874 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaaaaaagtgtgtgtgggcgcgcccggcgggccccgcgagaaaaagtttttgtgacaaacctcgttggtgtggggggcgcggggcccacgagataggaccagataaacagtggggccgaatcaaggcggttccataggaaagaacacgacggggtgaagcaacaggaacggggcgtaggggaagtgtcctccgccgagaatgaaaaaaaaacgcacccggggcggcaaacgcaggacggctttctgggagaacacaggtccgagaagaagggcagctccggaagcgagcgacccagggggcatatctaccaacaggacggcccacaggagggcacgcccgagaaatgaaaatgtggcccca

SEQ ID NO: 370846 - DNA, 581 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaagagctgcaatgggatggatgcgtgagcctccaaggcacagcccagggaagcctccccagagtcaggggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370847 - DNA, 601 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaattcttcccccatctgaccgtggtgcttttggccattggcatgttcttcaccgcctggttcttcgtgtatcctttcactgagcagccagaggaccagcattagtgatgtgggaagctcagggagaaaccacgctagattgccgtgggctgggctctctgcactccacagtccaccccttcgctttgccttaactgctgtgcccattacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370848 - DNA, 697 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaaagattgccgtgggctgggctctctgcactccacagtccaccccttcgctttgccttaactgctgtgcccattacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370849 - DNA, 510 bp, Homo sapiens
tgtctatagacactggtccacaaagctccggaaattgtaggcaaactttttcttgtatgtggtttttctcaggcagagagttcgtacctttagtcacgttttcatagtggtcagattattggcctcagaaaatgctaataagggccattgatctgcagctacatttccgggctaaaatcagcctctgtttcacggcagcaccaggctccttgataaccgcatgttctctccaggctgaaatcgtgggattctttgatagctctgatctctttccctcctctaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattagtgatgtgggaagctcagggagaaaccacgctaggtacatggaccccgccggttttgtacattggattggggctgagagaa

SEQ ID NO: 370850 - DNA, 579 bp, Homo sapiens
gcatgaccccttggttgatggagacagactcagtggaatgggtagggacactagacatttgtgcctctttccctgcccctcatacggatttgagccaaatgtgactctcagttctgagctcacatggcccaaggcctcgatctgcctttgggatgtaccacctagaagtgtggacgcaggcatcccatggctgtacatttacattcttagaagtcagaccccagtgacttggagaggctgctgggaagtcagctggctgaaagggggtcaagatccagggcttaaaacttgctgcagacaatccaccaaacaggccactaggaatcagctctggtggctcatcctcagaggtgtgtgctcaatagcccttgccccaggagcacaggggtgcagggagagaaggaggaaagaagggccattggtcttattttgatacccctctcctcttttaggtaacaaccagatggcttcactgaaacctgcttttgtaaattacttttttttactgttgctggaagtgtcccacctgctgctcataataaatgcagatgtatagcaaaaaaaaaaaaaaaaaaaaaa

SEQ ID NO: 370851 - DNA, 826 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagatgtatagcaaaaaaaaaaaaaaaaaaaaaaaaaaaaaaaaaaaaaaaaaaaaaaaaaaaaaaaaacaacaacagatgtggggcgagccggggcgcccgccagacaagaagttgctggagacacaacccaccagaggggggggccgcggaaccccacaagaggagaatgtacaccggcgaagcaagcgtgtccacacgagacatcccgcgtcaagaacgctgagggggggggggtcccccccaaaagaaaaaggccgcgggggaaacgcggcctgtgtgtaacaacaccacaggaggcgtggcacggcacgaggcgtacacagaagcacagaggagacgagaagcca

SEQ ID NO: 370852 - DNA, 941 bp, Homo sapiens
gaaatcgcaggactacaagtccctcaatgccacttgcgccggaggcacttccttttccggttgtgctaggcgcctgctcctgtcgacgtgttcttccggtggcggagcggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaaggctcctgtgcctgtctccgagcaacacctccacctctgcaccttcacctgggctgtcccacctgcctgaatggccctccccactccctgccagagctctcctctcctaagcctgaaggctgcagccccgggatctgcccctcggatgactggtgtctcagatgtcagcacttcactattcagctggggtggagacctattacatgcctccttggcgcccagactcaggacagcttcagatagaagcagtcgaggggcttgaggccctcgggcgtcttgacgtacttgggctcgcccagcatgccgatgtacactgtcacctggaagtggttcttcttctggcacacaaaggcgtcgtcgcccaccgaaaagttgaagcccttgtccgcatccacgcggtaggtttcacttttatcagtgttcaggaaaaagaacaaactcaacccaagaggtcaacacgtcctgcgtgaaccctgtgctcacccagcaagtggaaggctgtggccatatgggatccagctctttggccatccctggtccccacatctggagcaactccc

SEQ ID NO: 370853 - DNA, 1187 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagagtccagctgtgcacaaacagccctttaatgtgcgacagctgaatactgttcacgctagttcccagtttctggtatctcaaggattcagggtttggacggtctacctttgcttggagctataaaagtgtaccccgcctcccgttgtcggggatagtggagaattatgaagaactgatgaattgcccgacaaggttgtgctggtctatcaaaaaatttgggcagaagttctccaataattgctatggtccttcgttgcttggactaatagtag

SEQ ID NO: 370854 - DNA, 632 bp, Homo sapiens
gacaatttctggcttgaatatggaatcctgcttcaggaataaacagaaaacaccgctaatttctatagttgaaggatatcattggcttctggttgtatgtgccatggctgaagtgttttttgctattagcattttcaagtttatccactgtttcttttacaggttaactaccctgtaaaattacttaaaaaaaaagtgttaaggcaatgtcatcaacataggctggcattttatgtgcatcctaaaatggaggattcctttccatgtaaacaaggtaaaagaataattattctgtaaaagtcagtttaatctgtttgtatatttgcctcatctatagaaggagctaaagcatacagatgacttaacacttcaaaatacattgatacagtttaattaattttgaagccaaaactagccaaactgtgtgcattaactaccatatttatgatgtagcactgggtatgttctctgcataaatctctgtggttttagtcttgtcccaactttcagccaactgcattcactacttggttggtgcctgtggccttagggctactacatagtcttcagtgcccattcttgatgaaaagtagagaataacctgtataataaacaaacattgtttaactcag

SEQ ID NO: 370855 - DNA, 2424 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaacctgcttttctagtttttatattatttgcctctcatcacttctgcatagctcctggcagttacttcttaacagtgttctatgctggaagcctttatctaaactaaatacagggatgacctcttagcaatcttgccatcaatattatattcaagaaaataaaagttcggttatttgt

SEQ ID NO: 370856 - DNA, 1855 bp, Homo sapiens
aagccattcccctccaggggctgcaagttcccatccataaatcagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370857 - DNA, 2143 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaaggttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370858 - DNA, 2230 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagtgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370859 - DNA, 2068 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaaggttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370860 - DNA, 1136 bp, Homo sapiens
taatgttttaccacaatttaacactattttacagtaatctttaactgtagaattgctgtttttcatgttaggttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370861 - DNA, 1238 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatatgttggcagtgtttggactctgggcactgtttggactctgggcactgtttggactctg

SEQ ID NO: 370862 - DNA, 1457 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatatgttggcagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaag

SEQ ID NO: 370863 - DNA, 1005 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggaatttatgatgtagcactgggtatgttctctgcataaatctctgtggttttagtcttgtcccaactttcagccaactgcattcactacttggttggtgcctgtggccttagggctactacatagtcttcagtgcccattcttgatgaaaagtagagaataacctgtataataaacaaacattgtttaactcag

SEQ ID NO: 370864 - DNA, 2245 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370865 - DNA, 1113 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatatgttggcagtgtttggactctgggcactgtttggactctgggcactgtttggactctg

SEQ ID NO: 370866 - DNA, 2284 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370867 - DNA, 1875 bp, Homo sapiens
cgggctgcaggaattcggccacgagaagaagcttacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370868 - DNA, 2191 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagtgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370869 - DNA, 1538 bp, Homo sapiens
caggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacagctggggtggagcgaggcgcacagcctgggtggagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcatataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggtaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaatagcatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatta

SEQ ID NO: 370870 - DNA, 1112 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370871 - DNA, 952 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctc

SEQ ID NO: 370872 - DNA, 980 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctc

SEQ ID NO: 370873 - DNA, 1607 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaacaaaaaaaaaaaaaaaaaaaaaaaaaaaaaaaaaaaaacaaaagaaaaaaaaaaaaaaggaggggggggcgcgccacaaaaaatatacccccgcggggggagcccacacatgtcggaccgccccgcttttggcgaaaaaaggggggcccccaaatgaggggggcgcaatattataaacgtagacacagggcgcaccatgtttataaaccaacccgttgtggtcggcgggaaaaaacagctctcctgtcggagcgaacacgtgtgagagaaggaccccctactctcgggggggggaacaatatatgggaaccacctcccccaccgaaattttaaccgccccggggataaatcttaaaccctttgggcggtttcattggttgctttcaaccacacacgtaatatgtgtcgagcagaagaaattatggcccacctgagtagtgatttcgagacaatcatacgtcagggggtatcatga

SEQ ID NO: 370874 - DNA, 1645 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaacaaaaaaaaaaaaaaaaaaaaaaaaagagggcggcgcgccgcgcccagaagaagattccccccggaggggcgccccaggtccgagcgcgctcccccggtttttgtgtggccccgaagggggcccccataaggggcgcctccgttttatcttcgcccttccgcgcccggtgcgcccgtcttttcacaccacccgttgtgcaccgtgggaaaaccgcggtccctgttgggctcctctttggacgagggcgcccctttctctccggggggggccacatttctgcggacaacactatacccttcacgggaatttataaagcccccactaaagggggatcacacctctactgaacaccttcctcacacgggggtatacaccggggggtgtaaccacacatatacgctgaacaataatcgcccgaggcgcgtgatgaacaacaccttgtgcgccctcacccggagcgtatctaatctctcacgcacatgctttttatcccaggggactccttaacgtaa

SEQ ID NO: 370875 - DNA, 1072 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatctaataagagtttccattgtagaatgttttcacatacttgaataaatcaaatctttaattgag

SEQ ID NO: 370876 - DNA, 1447 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctcaaaaaaaaaaaaaaaaaaaacaaaaaaaaaaaaaaaaaaaaaaaaaaaaaaaaaaaaacaaaagaaaaaaaaaaaaaaggaggggggggcgcgccacaaaaaatatacccccgcggggggagcccacacatgtcggaccgccccgcttttggcgaaaaaaggggggcccccaaatgaggggggcgcaatattataaacgtagacacagggcgcaccatgtttataaaccaacccgttgtggtcggcgggaaaaaacagctctcctgtcggagcgaacacgtgtgagagaaggaccccctactctcgggggggggaacaatatatgggaaccacctcccccaccgaaattttaaccgccccggggataaatcttaaaccctttgggcggtttcattggttgctttcaaccacacacgtaatatgtgtcgagcagaagaaattatggcccacctgagtagtgatttcgagacaatcatacgtcagggggtatcatga

SEQ ID NO: 370877 - DNA, 1140 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370878 - DNA, 983 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370879 - DNA, 798 bp, Homo sapiens
gttcgttatgaggttcgcattaataaattaaagctccacgaggttcagctgtctcttacttttaaccagtgaaattgacctgcccgtgaagaggcgggcatgacacagcaagacgagaagaggaaaaagactgtgcaacggatagcccctggagagtgccccgtgtttacattctcatctggcatttttgttttgtggaatcggcctgtgttaagccaggtgacctatgaacagtgcttgtctcctcactaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370880 - DNA, 1076 bp, Homo sapiens
ctttacatgtcgtctccgatacatgttcccttgatccgagatccacaaggcacccctctgtgatctaacacggcgatcgagaggaacctgtaggacttccggtatgcccggaacctcgcagcccccttgaccgcttgccagaccccgatgtgccctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaacaaaaaaaaaaaaaaaaaaaaaaaaagagggcggcgcgccgcgcccagaagaagattccccccggaggggcgccccaggtccgagcgcgctcccccggtttttgtgtggccccgaagggggcccccataaggggcgcctccgttttatcttcgcccttccgcgcccggtgcgcccgtcttttcacaccacccgttgtgcaccgtgggaaaaccgcggtccctgttgggctcctctttggacgagggcgcccctttctctccggggggggccacatttctgcggacaacactatacccttcacgggaatttataaagcccccactaaagggggatcacacctctactgaacaccttcctcacacgggggtatacaccggggggtgtaaccacacatatacgctgaacaataatcgcccgaggcgcgtgatgaacaacaccttgtgcgccctcacccggagcgtatctaatctctcacgcacatgctttttatcccaggggactccttaacgtaa

SEQ ID NO: 370881 - DNA, 165 bp, Homo sapiens
tgctgggattacaggtgtgagccaccacacccggccccgagttctgagtcttctaagctttcaatttatgtttggtacttgttctctgttgctccaattctgcctgatcaatgcaggagtcctgtacctctacttcagcaattacctacagattgatgaggaaga

SEQ ID NO: 370882 - DNA, 1093 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370883 - DNA, 1222 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcagggaaaggccattgctgctctggagctgtgtgtgtgtgtgatgactaaagcaaagaagcagccctacagtggcactcctgggtctggtgcaccactcctcaggagcatctcaattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgag

SEQ ID NO: 370884 - DNA, 709 bp, Homo sapiens
  misc_feature (649)..(650): n is a, c, g, or t
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtggcttttccccccccccctttnnaaaattgtgcccccccaaaaaggggggtttttaggaccctcttgattacagcacaggaa

SEQ ID NO: 370885 - DNA, 1310 bp, Homo sapiens
  misc_feature (956)..(956): n is a, c, g, or t
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctcaaanaaaaaaaacaaataacaccatcacataaaacaacacttgtttgggggccgccgctcggggcccacggagaaaacgttttcgctaaaaaactagttgttggggcgacgcgcggtgccccccctcattgtgaactgtcagtacagtggctgcccataagctgtgtctcccacttaggaaaaactcctcgggactgtcgacataggtgagtggacttctccgcccaattaaaaaaccgccccgggcggtaccacacgagcggttcttagacaacatctcccaaaggaggtcatagagggacaaagacggggaattcatctaccaggagggtcacagcaggagctgaatataaattcg

SEQ ID NO: 370886 - DNA, 1019 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacccagcatggctgtatgtgcgtggtccatagcacagtacatgcagcatctaataagagtttccattgtagaatgttttcacatacttgaataaatcaaatctttaattgag

SEQ ID NO: 370887 - DNA, 958 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttgggtatgagtatgttgattcagcaatattgcttgaacccgtaaggcggtggatcctgtgagttgagatcatgccattgcactccagcctgggcgacagggcgagtctctgtctcaaaaaataaaaaataaaaattcattagatcaaaaaaaaa

SEQ ID NO: 370888 - DNA, 237 bp, Homo sapiens
ggatcatctagatagaaaatcaacaaagaattatcagatttaaattacattctagaccaaatagccccagcagatatttataaaacattcccctcaataactactgaatgtacattttgctcaacagcacatggaacttttctccacgatagaatatatgttagtccacaaaacatatctcaagcaatcaaaaaaatcaaaatcttatcaagtatcttctcttaccacaatgcaata

SEQ ID NO: 370889 - DNA, 968 bp, Homo sapiens
aaccaggccagtttccatcgcacatgtgtcccgcagctccaccgaaaaggatcaagaaagtcaggattctaaataccaacagcatcactctgtcaaaaccacccttgcaacctttctcagaaaaggaaatgtaatgacaagatgaaagttagccagaacggccatgtccagaaaagctctcagtagtacagccatctgtccgaaatactctaacctacaaggtggccacggtctcttcagagggtcatggagctctgcaaagcttgtcttaaaactgattaaggttgttaaactgaaccatcttgactggccccagccaagtttcttacagtggaaatggcacattaactatgcagctgtcatgagagaagtcagtactcttagattctaacccaaaagaattcaaatatattggatttcctctcctgttcaattggaattcaaggacttaatccacttttaattacactgttcctgttgttgcatcaaaagggaaagaaaagaaaaaagaaactgtttgcagagaacgagcagagatcttgggaataccatcctccattgagagccagcccctcaaaagctcattcgtagggctgggtaaacacacaccttttgcactctatttttgaaattatgttcaggagtctacagactgttatctgtagaagaagccacttttgaaattttagtttatgtaaagtgttccaaaatgcatgaacagagtaattattttaaaagtctataaatgcatgcatttgctctaaaattttgtaattatcagtagattacaagttctctataggaagagagagctgtctcatattagttttgcacttataccttttttaatagttctgaacttcactcttgtgtattcttttattttaaaagctataatgactaatcctgatcttctgctggaatatggttaaataggattccattaaaaacaagagctagaattcatg

SEQ ID NO: 370890 - DNA, 554 bp, Homo sapiens
ttttggaattggtctgatgcaaaagtcaatgcttttctgtccagttgaaccagccttgtttaatttttttttttaaagggaaagaaaagaaaaaagaaactgtttgcagagaacgagcagagatcttgggaataccatcctccattgagagccagcccctcaaaagctcattcgtagggctgggtaaacacacaccttttgcactctatttttgaaattatgttcaggagtctacagactgttatctgtagaagaagccacttttgaaattttagtttatgtaaagtgttccaaaatgcatgaacagagtaattattttaaaagtctataaatgcatgcatttgctctaaaattttgtaattatcagtagattacaagttctctataggaagagagagctgtctcatattagttttgcacttataccttttttaatagttctgaacttcactcttgtgtattcttttattttaaaagctataatgactaatcctgatcttctgctggaatatggttaaataggattccattaaaaacaagagctagaattcatg

SEQ ID NO: 370891 - DNA, 455 bp, Homo sapiens
tacctctgttgtaaagttcttggtgaaggttccgaagatgaaggtggagaaaacaaaaagagacagctgagagaggggtcagaaccaggcaaggggacgaatgagagtgaacctgagacactcaagctttaaggagaggaactgtctccatgaaggccccacatttgagaacactgggtaacagcctaagtggtctcctacggattccttcttttgagcagcttgttcctagcctggcattcaatgaacttgccaccaacagagaagcaggggatgagggccaaagaaaggaggagaagagctctcagaatttccaattagcacatttaagcagtgaaaatgtatcagacctgaccagaatacaatacattgtatgattaggaccacaattccaattagtggcagatacaaaagctcagctctcaatgtgaaaaccaaccagaaaggtgagattt

SEQ ID NO: 370892 - DNA, 349 bp, Homo sapiens
cacagcagaggctggaaaagctgacactgccggcttcctctgccgctggccaggcaggccccaggcctctttacacagctctgtttgtcaatagagatggagctttgtctccccctccagattctaccccaacccacatcccagcacccaacaaagacccttttagatcagagcctgtgtggggtagaatggagaccagaggcagagttattgccccacggctgtgagcaggccccacgcagagtagctcgctaccaggccagagaccacccagccaaggctcctcaggcttagacgttcccagctcccatttctccccaggtctcccagcagctggccttgggaatcc

SEQ ID NO: 370893 - DNA, 821 bp, Homo sapiens
ccttgtccacttcgatgtagccgtcggtattcactccagcgacttccctgccttgtctgtaactcggcaggcactaggcgcattggctgagcccacgcatcccggtccctcgttgagcccaggggccgaatgaggtccgcacctgctggtctcttgcctttgatacgcctgtctatgccctcttaaccagcttcacgcggatgttattgtgaggtctggtaggtagcctgtggtgtccgcgttgaggttctcggaagggctcggattcggggctggcccccagcccttgtccattcccttcccacccatccagccttgtggtccggttaaatgtcttctcccaaaccacccggggctctcccggggcccaggcttctttatgaggcttcttgtgtccatttcccagctgccaggtcttgccagcccttgaaactggaggaggccatatctttcttgggacccaccaccagaagcccagggaccagagagaagctttctgtgccccagatcttgcccccagagcggctgcggccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370894 - DNA, 332 bp, Homo sapiens
  misc_feature (60)..(60): n is a, c, g, or t
  misc_feature (63)..(63): n is a, c, g, or t
  misc_feature (70)..(70): n is a, c, g, or t
ccccacaccccccggcacccacctaggtaggtgcgaggcccggttaatcggaagaggcantgntgagagnaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370895 - DNA, 626 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaccgtccggactttgggccaactggcccattgcccctaaaagggttttgttttccacccaattggcggcctttttacaccattgccctttaggaaaccccggtaaaaaccaaactgaccggctttgaacacaatccccttttgcttggggtatacccaattatgccgcctggaccgacttcccctttggggcgggtggcttggcgggccccctcccct

SEQ ID NO: 370896 - DNA, 639 bp, Homo sapiens
  misc_feature (2)..(2): n is a, c, g, or t
  misc_feature (4)..(5): n is a, c, g, or t
  misc_feature (8)..(8): n is a, c, g, or t
  misc_feature (361)..(361): n is a, c, g, or t
  misc_feature (433)..(433): n is a, c, g, or t
  misc_feature (447)..(447): n is a, c, g, or t
  misc_feature (518)..(518): n is a, c, g, or t
  misc_feature (538)..(538): n is a, c, g, or t
  misc_feature (541)..(542): n is a, c, g, or t
  misc_feature (549)..(549): n is a, c, g, or t
  misc_feature (552)..(552): n is a, c, g, or t
  misc_feature (565)..(565): n is a, c, g, or t
  misc_feature (570)..(570): n is a, c, g, or t
gngnnggnacccggagaaacggccattatggccggggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaacantttgcgggggcccgtgggccctggaaaaagtttttaaaaaccaatcgcgtgggggggcggcgggccccgtgngtgaaggtggaacngggggccaaaagcgggtcccagaagaaacccggggccagggacacaaggggcggggtttctccccccaatnaaaaaaccccgggggggcanccnnagcggtnctngaaccaatcccangaggngaggtccggagggcactaaggggcctctacaaccgggaggccaaggggaggcccgtataaaataacgga

SEQ ID NO: 370897 - DNA, 250 bp, Homo sapiens
  misc_feature (43)..(43): n is a, c, g, or t
gtggtgttctggtggtgtgttggcaaacactaaccaaaaaaanatagagtccgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370898 - DNA, 281 bp, Homo sapiens
gctgctccagtcaatgaaagggacactttattgaggctccagggccacggggcctgggcaggaggctgcccttcaaggaaagaaccaccttatttgaccttcttcttggaacgcaggttgttggtgtgaccacacttcttcttgcggcagttgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370899 - DNA, 480 bp, Homo sapiens
cagtgagtggagatggctccattgcactccagtccgggagacagcgagactctctctcaaaaaaaaaatgatgaactgtgtaattatagttgcctactgaacaactatcctgtgcatttggtaaagatcatttactagtgttttgggaaacattactttgatggaagaagtgcgatagcgttactaaaaatcgttctaaaacatggttgattctggagtaggcattcagtaaatatttaaactacatagaatctggtgtggtttggataggtcaaaggtccagttctgtaattctataacattctataatgagccttttttttgtgagaatcaagtagagatttaaagcattttgaaataaatcatctgctttttttttttcattggactaaatgctcttccttcagaggattatccggggcatctactcaatgaaaaaccatgataattctttgtatataaaataaacatttgaaaaaa

SEQ ID NO: 370900 - DNA, 356 bp, Homo sapiens
gcttttacctcgttgcactgctgagagcagatggtcacagcagtgtactgagccaccgcgaaaattcggccagggttctcgctcttgtcgtgtctggttcaatacccggggcaaccgggctcctgggattcccggggaaaaattaattggcgcttccaaattaattgtttgcccggcccaaggttggttttttcccccgggttccaaggcttaacccggccggaaaaggggattatttccgggtttttccatttaaagcttggactaaatgctcttccttcagaggattatccggggcatctactcaatgaaaaaccatgataattctttgtatataaaataaacatttgaaaaaa

SEQ ID NO: 370901 - DNA, 328 bp, Homo sapiens
  misc_feature (41)..(41): n is a, c, g, or t
  misc_feature (43)..(46): n is a, c, g, or t
  misc_feature (48)..(48): n is a, c, g, or t
  misc_feature (50)..(50): n is a, c, g, or t
  misc_feature (52)..(52): n is a, c, g, or t
tctctctctctctctctctctctctctctctctctctctcncnnnntntntntctctctctctctctagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370902 - DNA, 1095 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgaaaaaacacccccggggggggccaacgccgcacacccagctatttcatcttaaaaaaaggcggggccactaataagggggcggatttacaaaaaaaaccagcacgcgagcaggcgcagaacaaaacaccacaatagcaggagagcaacaaacaaggtcaatcgaggaccatcgataagaagaacccacaacatgggggggggagaccattagcgcgagacacacaacaacgaaaaaaataacgccgccggagagaaaaaaacactacgagcgttaaggagggaaacaacccacgataaagacgctgggggggagaggaaacgtcggccgacccgacgaggggaaaacaaaacaaaccgacccgggctcgttgttccacaataggggagcagtcgagcgaacagaccgacgagacagcagcagaccaaataggagagcagagcagaaggaacacaacgaacgagacgaggaaacagcgaggacaggaagagagcacaagagacccagaagaaaagagaacacagagggaacgccaaggacagcagaacagaaggcaagcgaacgcgaggcacaaaaggcaagaaccaaatagcaaccaaagcaagagcagcagagaagaggaagcaaaacaagagtgtagagagcaccaagaagaacgacagtagatacaa

SEQ ID NO: 370903 - DNA, 639 bp, Homo sapiens
  misc_feature (361)..(361): n is a, c, g, or t
  misc_feature (433)..(433): n is a, c, g, or t
  misc_feature (447)..(447): n is a, c, g, or t
  misc_feature (518)..(518): n is a, c, g, or t
  misc_feature (538)..(538): n is a, c, g, or t
  misc_feature (541)..(542): n is a, c, g, or t
  misc_feature (549)..(549): n is a, c, g, or t
  misc_feature (552)..(552): n is a, c, g, or t
  misc_feature (565)..(565): n is a, c, g, or t
  misc_feature (570)..(570): n is a, c, g, or t
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaacantttgcgggggcccgtgggccctggaaaaagtttttaaaaaccaatcgcgtgggggggcggcgggccccgtgngtgaaggtggaacngggggccaaaagcgggtcccagaagaaacccggggccagggacacaaggggcggggtttctccccccaatnaaaaaaccccgggggggcanccnnagcggtnctngaaccaatcccangaggngaggtccggagggcactaaggggcctctacaaccgggaggccaaggggaggcccgtataaaataacgga

SEQ ID NO: 370904 - DNA, 783 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaagagagggggcggcgcgccgcgcccaaaaaattcccccggcggggggccccagttccgcggtcccccgttttttgttgccaaggggggcccccttaggggggcgcagcaattataaagcgctcgagagcggccgcgggccgccgtcgtttaaacaaacacagtggggcgatggggggaacacactctcgtctgattgcgggacgatcttctgcgcggaagacgacaccctcctcttccgcgggggggcgagcccttctgtgcgggccacccatccacctacgagatttttttagcgcccccagagggacaattgtcaacctttcacagtgtttcatcgttgtccaccccaaccggatattagccccgctagaaaattgggccgcgacttacactctggacactttttaccgacggtataa

SEQ ID NO: 370905 - DNA, 701 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccaaacgctatcgagaggagaccacatcacaacaaaaccccatcatttattagattaaaaacgaggggcccccttaacatagaagtggctttattaataaaacaaagaaggaacaagcgcacggttcttaaaaaaaacatgtggtgagaggaggaaaacaaaactctttgacgtgcgatttctggggagaaagaacacaactatctgttggggcgagagacaaaaatgggggaaaaaactaatcagaaattattcctctcggagggat

SEQ ID NO: 370906 - DNA, 1094 bp, Homo sapiens
  misc_feature (678)..(678): n is a, c, g, or t
  misc_feature (682)..(682): n is a, c, g, or t
  misc_feature (693)..(693): n is a, c, g, or t
  misc_feature (697)..(697): n is a, c, g, or t
  misc_feature (714)..(714): n is a, c, g, or t
  misc_feature (719)..(719): n is a, c, g, or t
  misc_feature (723)..(723): n is a, c, g, or t
  misc_feature (725)..(725): n is a, c, g, or t
  misc_feature (729)..(729): n is a, c, g, or t
  misc_feature (732)..(733): n is a, c, g, or t
  misc_feature (736)..(736): n is a, c, g, or t
  misc_feature (740)..(740): n is a, c, g, or t
  misc_feature (746)..(746): n is a, c, g, or t
  misc_feature (757)..(757): n is a, c, g, or t
  misc_feature (760)..(760): n is a, c, g, or t
  misc_feature (763)..(763): n is a, c, g, or t
  misc_feature (767)..(767): n is a, c, g, or t
  misc_feature (775)..(775): n is a, c, g, or t
  misc_feature (786)..(786): n is a, c, g, or t
  misc_feature (797)..(798): n is a, c, g, or t
  misc_feature (802)..(802): n is a, c, g, or t
  misc_feature (827)..(828): n is a, c, g, or t
  misc_feature (839)..(839): n is a, c, g, or t
  misc_feature (844)..(844): n is a, c, g, or t
  misc_feature (849)..(849): n is a, c, g, or t
  misc_feature (855)..(855): n is a, c, g, or t
  misc_feature (859)..(859): n is a, c, g, or t
  misc_feature (872)..(872): n is a, c, g, or t
  misc_feature (884)..(885): n is a, c, g, or t
  misc_feature (887)..(887): n is a, c, g, or t
  misc_feature (889)..(889): n is a, c, g, or t
  misc_feature (892)..(893): n is a, c, g, or t
  misc_feature (899)..(899): n is a, c, g, or t
  misc_feature (912)..(912): n is a, c, g, or t
  misc_feature (914)..(914): n is a, c, g, or t
  misc_feature (918)..(918): n is a, c, g, or t
  misc_feature (922)..(922): n is a, c, g, or t
  misc_feature (924)..(924): n is a, c, g, or t
  misc_feature (926)..(926): n is a, c, g, or t
  misc_feature (932)..(933): n is a, c, g, or t
  misc_feature (939)..(939): n is a, c, g, or t
  misc_feature (947)..(947): n is a, c, g, or t
  misc_feature (958)..(958): n is a, c, g, or t
  misc_feature (988)..(988): n is a, c, g, or t
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacangganaaaaaaaaaantttncttgcggccgaatttcnggctnattngnccanttnnccntatngggagncgttaacattnaanggnccgnggtttaanaccgtggggangggaaaacccnngggntacccaattaattggttggaagaanntccccttttgncaggnggggnattacnaaanaggcccacccgtnggcctttccaannantngcnnaccctnatgggaatggaantngaangctnantntttggnnaaaatncgggtaanttttggtaaanaacttatttttaaccaataggccgaatggnaaattcctttttattaaaaggaataacccggaatagggtggagggtggtccagtttggaaccagaagccatttaaagaacggggcttccgaggggccgcattgggg

SEQ ID NO: 370907 - DNA, 1124 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaactggtggaaacacagaggtattgacaacagggttcatagaaggtttgagggccagatctatgcccaacattggttatgggagaaacaaaaagacaaagcacatactgcccagtggcttctggaagttcctggtccacaacgttaaggagctggaagtactgctggtgagcaacaaatcttactgtgttgagatcactcatgatgtttcttccaagaactgcaaagccatcttggaaagagcagcccaggtggtcatcagagtcaccaatgccaatgccagcctgcacagtgcagaaagtgaatagacagtgaatgtgtttgttttattggggtttaaataaaaccaataaaactgtaaaaacaacaaaaaacaaaaaccagagacactg

SEQ ID NO: 370908 - DNA, 895 bp, Homo sapiens
  misc_feature (839)..(839): n is a, c, g, or t
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaccaaaaaaaaagaaaaaaaaactcgcggcacgaggattgcctagggcagaaaggaagtgggaatggcgaagatgtgacattcctcggtgttagatcctgttttttcttaacaagttgaggcgtgggtagagcaggaattggttttccagcattgtgtccgtaancctgagttagaataagatgtaacggaagccacgataaagactcggtcaaatcctgc

SEQ ID NO: 370909 - DNA, 1040 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacaaaaaaaaaaaaaaaaaaaaaaaaaaaaaaaacctgtgtgtgcggggcgcgcccgccggcccccggaaaaagccttttaagaacccacccgcggggggcgcgcgcgcggggccccaggggaaggggaaaccgggggcgcacagaagggtggtcccccaagaggagaaaactcgcggggccccaggaacaagagggcgcggggacttctctctcaaccaattataaaaaacacgccccggggagccacaccgacggcgtttcgtgaaacaaactctccgacaagggccgtcgcgggaggcccaccaagggggggccctttccaacacgcgggccccaagcggaacccgaaatcaaaataagccca

SEQ ID NO: 370910 - DNA, 1441 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaagggacgcgtgggtcgacccacgcgtccgggacccaggcgtccgggtggactatgtctctacaaaccacaaagactttgggaacactatacctattattcggcgcatgagctgggagtcctaggcacagctctaagcctccttattcgagccgagcggggccagccaggcaaccttctaggtaacgaccacatctacaacgttatcgtcacagcccagtgcattgggaaataatcttcttcatagtaatacccatcataatcgggaggcttgggcaactggactagttcccctaataatcggggcccccgatatggcgttcccggataaacaccataagcttctgactcttacgtcctctctcctagtctggtcgcatctgcataagggagggccgggaccaggaacgtttggaacagttaacctcctttagaggggagtaatgccaccttggagctccgtaaacttaccatttttcttaaactagcgggtgccaccaactagggcgcacaatttcacacatttcattaaacctggataccaataaaggcccattgaagaccgggcaaacaagaggcaatttaaattctccagcaaagggggcactatataacaaggacgagctagcattttgacccggggggacctttagacacagatagttggcaggagtcttcaacagagacactattaactaaacagtaatgtgcatcacctggccgatgtagcgagtccacgctactcagcctcttc

SEQ ID NO: 370911 - DNA, 1387 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaactcacaattccaaatccgcccaagaattcccggtctgcgctgatatctcctattgttctggggcagacccctcgttctatcacgcgtccgagaaccccttgaaaggcacttgttgaaccccaccttctgtgcattgcacggggctggtaataaacatgggggtgtgacaacacacccaccgttggtgttcccccaaaaaagaggtcttccgaaaagcccgcgtgtccttcacaagaatagaccgtgaaaaaccctctgtgggtttggagcccccctggacccaaacactgagcacaaacagtgggccacttagtaatgtggaagtatccccccgtggaaaaacccaagggaaattacatcgggctataggcggagggacagggagacaaatatgcgctggaacaaaatttctttactatttcgcccttgaactatggggacccccaccaagagttctcgttatctgcctgtttgtaaccgccagtttctgtgccattttggggggcgacatgtataggggtttcccgtgtgtctccaaatctcgttgggtagtcccccgagtgtctccgcgttcgtgggagtcacactcttctcgtgagtgccccccctttactatttttcccacgggtttgctcccttttatccccacgtattttggtgaccccctttcccgg

SEQ ID NO: 370912 - DNA, 1115 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaaaaaaaaaaaaaaaaaaaaaaagggggggggcggccaaaaaacccccccggggggccccatcccacccccccattttttttgtcaaaagaggggggcgcccctaaaggagggcgggctataatataaagacaagagacagacgggcgccccgtataaaaacacaacgcggggcgggggaaacaccatggcgctgcggaggagaacctgtggaggaagagcaccccaacatcgggggcggcgcacacatagggggcacaacatcccccaaacgagaaattaacgcgccccgggacaacacaccggcagcgaataggtcggcaaacaccacgcgaatatcgcggccggagaaaaatttgcccagcagaaaactctagacattaacggggggcgaaaaaaag

SEQ ID NO: 370913 - DNA, 1133 bp, Homo sapiens
  misc_feature (701)..(701): n is a, c, g, or t
  misc_feature (707)..(707): n is a, c, g, or t
  misc_feature (717)..(717): n is a, c, g, or t
  misc_feature (721)..(721): n is a, c, g, or t
  misc_feature (732)..(732): n is a, c, g, or t
  misc_feature (736)..(736): n is a, c, g, or t
  misc_feature (753)..(753): n is a, c, g, or t
  misc_feature (758)..(758): n is a, c, g, or t
  misc_feature (762)..(762): n is a, c, g, or t
  misc_feature (764)..(764): n is a, c, g, or t
  misc_feature (768)..(768): n is a, c, g, or t
  misc_feature (771)..(772): n is a, c, g, or t
  misc_feature (775)..(775): n is a, c, g, or t
  misc_feature (779)..(779): n is a, c, g, or t
  misc_feature (785)..(785): n is a, c, g, or t
  misc_feature (796)..(796): n is a, c, g, or t
  misc_feature (799)..(799): n is a, c, g, or t
  misc_feature (802)..(802): n is a, c, g, or t
  misc_feature (806)..(806): n is a, c, g, or t
  misc_feature (814)..(814): n is a, c, g, or t
  misc_feature (825)..(825): n is a, c, g, or t
  misc_feature (836)..(837): n is a, c, g, or t
  misc_feature (841)..(841): n is a, c, g, or t
  misc_feature (866)..(867): n is a, c, g, or t
  misc_feature (878)..(878): n is a, c, g, or t
  misc_feature (883)..(883): n is a, c, g, or t
  misc_feature (888)..(888): n is a, c, g, or t
  misc_feature (894)..(894): n is a, c, g, or t
  misc_feature (898)..(898): n is a, c, g, or t
  misc_feature (911)..(911): n is a, c, g, or t
  misc_feature (923)..(924): n is a, c, g, or t
  misc_feature (926)..(926): n is a, c, g, or t
  misc_feature (928)..(928): n is a, c, g, or t
  misc_feature (931)..(932): n is a, c, g, or t
  misc_feature (938)..(938): n is a, c, g, or t
  misc_feature (951)..(951): n is a, c, g, or t
  misc_feature (953)..(953): n is a, c, g, or t
  misc_feature (957)..(957): n is a, c, g, or t
  misc_feature (961)..(961): n is a, c, g, or t
  misc_feature (963)..(963): n is a, c, g, or t
  misc_feature (965)..(965): n is a, c, g, or t
  misc_feature (971)..(972): n is a, c, g, or t
  misc_feature (978)..(978): n is a, c, g, or t
  misc_feature (986)..(986): n is a, c, g, or t
  misc_feature (997)..(997): n is a, c, g, or t
  misc_feature (1027)..(1027): n is a, c, g, or t
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacaaaaaaaaaaaaaaaaaaaaaaatngggggnggagggccangganaaaaaaaaaantttncttgcggccgaatttcnggctnattngnccanttnnccntatngggagncgttaacattnaanggnccgnggtttaanaccgtggggangggaaaacccnngggntacccaattaattggttggaagaanntccccttttgncaggnggggnattacnaaanaggcccacccgtnggcctttccaannantngcnnaccctnatgggaatggaantngaangctnantntttggnnaaaatncgggtaanttttggtaaanaacttatttttaaccaataggccgaatggnaaattcctttttattaaaaggaataacccggaatagggtggagggtggtccagtttggaaccagaagccatttaaagaacggggcttccgaggggccgcattgggg

SEQ ID NO: 370914 - DNA, 561 bp, Homo sapiens
aggatccttaattaaattttttccccccccccccccgcttttacctcgttgcactgctgagagcaagatgggtcaccagcagctgtactggagccacccgcgaaaattcggccagggttctcgctcttggtgagaaatagtttgtgattttggggaagcgttgccgtggagcgctaggctgcttaaaatctcaagtagaggaggccacgggcggcacgagggagcacgccgactgggagtcgctggtgccgccattacaggcctgtactgtggcttgggagtcccgggatgcgggtagtagccgtctgagtgcggagtcttgtaatttctatgacctgcaaaaccgctgtctcttttcttacagtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370915 - DNA, 1147 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaaggtaggcgtctgcaggcgtactccatgttgtttgggcagagaaggttgtgggggttattttttccgcgaaagacaaacggacagatcttccctggagtggtaattctgagcattcgaccaagagcttttcctctttttttagttggtagctggtgacagtgttgatggtttgggcaatcaaattaatagaatggagaaggtgaaggacttagtctttcctactcccttttttacctagatagcttagccagttttaggtgccgtgtattgtgtttggtgaaattcactttagagaagccactaaaattgttttacattgtttcatttatcaatcttgtaagtacctattctctttttttttttcttagagatagggtctccctctgtcgcccaggttgaagtgcagtggcgttgttacggctcactgcagcctcgaactcctcctggtctcaggcgatcctcttgccttggcgtcccgagtagctgggactaaaggctcttgccaccacgcgcggctgtacctagatattttctaaccaaatatatgtattaaccgctgaccccaagttt

SEQ ID NO: 370916 - DNA, 781 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaaggagatagggtctccctctgtcgcccaggttgaagtgcagtggcgttgttacggctcactgcagcctcgaactcctcctggtctcaggcgatcctcttgccttggcgtcccgagtagctgggactaaaggctcttgccaccacgcgcggctgtacctagatattttctaaccaaatatatgtattaaccgctgaccccaagttt

SEQ ID NO: 370917 - DNA, 855 bp, Homo sapiens
cagtgagtggagatggctccattgcactccagtccgggagacagcgagactctctctcaaaaaaaaaatgatgaactgtgtaattatagttgcctactgaacaactatcctgtgcatttggtaaagatcatttactagtgttttgggaaacattactttgatggaagaagtgcgatagcgttactaaaaatcgttctaaaacatggttgattctggagtaggcattcagtaaatatttaaactacatagaatctggtgtggtttggataggtcaaaggtccagttctgtaattctataacattctataatgagccttttttttgtgagaatcaagtagagatttaaagcattttgaaataaatcatctgctttttttttttcattggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccaaacgctatcgagaggagaccacatcacaacaaaaccccatcatttattagattaaaaacgaggggcccccttaacatagaagtggctttattaataaaacaaagaaggaacaagcgcacggttcttaaaaaaaacatgtggtgagaggaggaaaacaaaactctttgacgtgcgatttctggggagaaagaacacaactatctgttggggcgagagacaaaaatgggggaaaaaactaatcagaaattattcctctcggagggat

SEQ ID NO: 370918 - DNA, 435 bp, Homo sapiens
gtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcgggtaggtggatggagtgtgactggcttaactgcacctgagacgtggaaagaccgtccagaccgcacaaggccttcgtactcttgattttcttgattgattgaactaggacggggcccggctggggagtgggaagcgcctggggagcaaatgttaagcaggcgctcacggtcggggtcgtggtcttgcctccttaaaatttgtgctctaggcgcctctctcaccttaacctaatcctagccgtatattaaacattttattgtgtctgagt

SEQ ID NO: 370919 - DNA, 326 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370920 - DNA, 326 bp, Homo sapiens
  misc_feature (2)..(2): n is a, c, g, or t
  misc_feature (4)..(5): n is a, c, g, or t
  misc_feature (8)..(8): n is a, c, g, or t
gngnnggnacccggagaaacggccattatggccggggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370921 - DNA, 289 bp, Homo sapiens
  misc_feature (21)..(21): n is a, c, g, or t
  misc_feature (26)..(26): n is a, c, g, or t
  misc_feature (28)..(28): n is a, c, g, or t
gcccttccttggtgcactacngagangnagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370922 - DNA, 1079 bp, Homo sapiens
cacgcggtcgcggacgcgtggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgaaaaaacacccccggggggggccaacgccgcacacccagctatttcatcttaaaaaaaggcggggccactaataagggggcggatttacaaaaaaaaccagcacgcgagcaggcgcagaacaaaacaccacaatagcaggagagcaacaaacaaggtcaatcgaggaccatcgataagaagaacccacaacatgggggggggagaccattagcgcgagacacacaacaacgaaaaaaataacgccgccggagagaaaaaaacactacgagcgttaaggagggaaacaacccacgataaagacgctgggggggagaggaaacgtcggccgacccgacgaggggaaaacaaaacaaaccgacccgggctcgttgttccacaataggggagcagtcgagcgaacagaccgacgagacagcagcagaccaaataggagagcagagcagaaggaacacaacgaacgagacgaggaaacagcgaggacaggaagagagcacaagagacccagaagaaaagagaacacagagggaacgccaaggacagcagaacagaaggcaagcgaacgcgaggcacaaaaggcaagaaccaaatagcaaccaaagcaagagcagcagagaagaggaagcaaaacaagagtgtagagagcaccaagaagaacgacagtagatacaa

SEQ ID NO: 370923 - DNA, 675 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 370924 - DNA, 626 bp, Homo sapiens
  misc_feature (2)..(2): n is a, c, g, or t
  misc_feature (4)..(5): n is a, c, g, or t
  misc_feature (8)..(8): n is a, c, g, or t
gngnnggnacccggagaaacggccattatggccggggcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaccgtccggactttgggccaactggcccattgcccctaaaagggttttgttttccacccaattggcggcctttttacaccattgccctttaggaaaccccggtaaaaaccaaactgaccggctttgaacacaatccccttttgcttggggtatacccaattatgccgcctggaccgacttcccctttggggcgggtggcttggcgggccccctcccct

SEQ ID NO: 370925 - DNA, 880 bp, Homo sapiens
  misc_feature (448)..(448): n is a, c, g, or t
  misc_feature (454)..(454): n is a, c, g, or t
  misc_feature (464)..(464): n is a, c, g, or t
  misc_feature (468)..(468): n is a, c, g, or t
  misc_feature (479)..(479): n is a, c, g, or t
  misc_feature (483)..(483): n is a, c, g, or t
  misc_feature (500)..(500): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (515)..(515): n is a, c, g, or t
  misc_feature (518)..(519): n is a, c, g, or t
  misc_feature (522)..(522): n is a, c, g, or t
  misc_feature (526)..(526): n is a, c, g, or t
  misc_feature (532)..(532): n is a, c, g, or t
  misc_feature (543)..(543): n is a, c, g, or t
  misc_feature (546)..(546): n is a, c, g, or t
  misc_feature (549)..(549): n is a, c, g, or t
  misc_feature (553)..(553): n is a, c, g, or t
  misc_feature (561)..(561): n is a, c, g, or t
  misc_feature (572)..(572): n is a, c, g, or t
  misc_feature (583)..(584): n is a, c, g, or t
  misc_feature (588)..(588): n is a, c, g, or t
  misc_feature (613)..(614): n is a, c, g, or t
  misc_feature (625)..(625): n is a, c, g, or t
  misc_feature (630)..(630): n is a, c, g, or t
  misc_feature (635)..(635): n is a, c, g, or t
  misc_feature (641)..(641): n is a, c, g, or t
  misc_feature (645)..(645): n is a, c, g, or t
  misc_feature (658)..(658): n is a, c, g, or t
  misc_feature (670)..(671): n is a, c, g, or t
  misc_feature (673)..(673): n is a, c, g, or t
  misc_feature (675)..(675): n is a, c, g, or t
  misc_feature (678)..(679): n is a, c, g, or t
  misc_feature (685)..(685): n is a, c, g, or t
  misc_feature (698)..(698): n is a, c, g, or t
  misc_feature (700)..(700): n is a, c, g, or t
  misc_feature (704)..(704): n is a, c, g, or t
  misc_feature (708)..(708): n is a, c, g, or t
  misc_feature (710)..(710): n is a, c, g, or t
  misc_feature (712)..(712): n is a, c, g, or t
  misc_feature (718)..(719): n is a, c, g, or t
  misc_feature (725)..(725): n is a, c, g, or t
  misc_feature (733)..(733): n is a, c, g, or t
  misc_feature (744)..(744): n is a, c, g, or t
  misc_feature (774)..(774): n is a, c, g, or t
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaatngggggnggagggccangganaaaaaaaaaantttncttgcggccgaatttcnggctnattngnccanttnnccntatngggagncgttaacattnaanggnccgnggtttaanaccgtggggangggaaaacccnngggntacccaattaattggttggaagaanntccccttttgncaggnggggnattacnaaanaggcccacccgtnggcctttccaannantngcnnaccctnatgggaatggaantngaangctnantntttggnnaaaatncgggtaanttttggtaaanaacttatttttaaccaataggccgaatggnaaattcctttttattaaaaggaataacccggaatagggtggagggtggtccagtttggaaccagaagccatttaaagaacggggcttccgaggggccgcattgggg

SEQ ID NO: 370926 - DNA, 795 bp, Homo sapiens
aggatccttaattaaattttttccccccccccccccgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccttggggcccgcttggcccaagtcatttttaaattggggaaggtttttgatggggcccgaatttggggttcattggcccatttccccttatggggggcggtttaaaatttaatggcccggggttttacaagggggggatgggaaaaccctggggttacccaaatttattggctgtgaagaaattccctttttcgcaggtgggggaaatacaaaggggccccaccggatcccctttcccaaaatttgccaaccctgaatgggaaataggaaatggaagcgtttattttttggataaaatcggcgt

SEQ ID NO: 370927 - DNA, 944 bp, Homo sapiens
  misc_feature (776)..(776): n is a, c, g, or t
  misc_feature (800)..(800): n is a, c, g, or t
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaactccgggggcttcttttgcggggggcgggaaaaaggggtatttgaatgggcccatggggtccataggctggttcccnggaccccagttttctttgtccaangggggctaaatctggcgcgggtccccctataggggagcggaataaattccgagataagcgccgggttaccccggggtattatgacccgcgcaaaagcgcccacagaaaaaaacccaccaaaaacgaacgagaaataaggacaca

SEQ ID NO: 370928 - DNA, 1072 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccttggggcccgcttggcccaagtcatttttaaattggggaaggtttttgatggggcccgaatttggggttcattggcccatttccccttatggggggcggtttaaaatttaatggcccggggttttacaagggggggatgggaaaaccctggggttacccaaatttattggctgtgaagaaattccctttttcgcaggtgggggaaatacaaaggggccccaccggatcccctttcccaaaatttgccaaccctgaatgggaaataggaaatggaagcgtttattttttggataaaatcggcgt

SEQ ID NO: 370929 - DNA, 1029 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaactttgtgtgggccgccttgggcccttggggaagagttttctgtggcaccttcgggtgggggcgcgggggccctggttgggttaggtgtgcaccgtgggccaagaggggttccctaggggagaacccgggcgccttgagacaaaagggcgctggggttttttacccatttaaaaaacgcgccgggggggaacaccggaggcgtgttcgggaaccaaatccccaggagggagggtcacgagaggagcgcacattacaggggggcctattctcacccgggggaggccccaagggagagcccgagatttaaaattacccgagccatctctgggggggggagc

SEQ ID NO: 370930 - DNA, 1194 bp, Homo sapiens
  misc_feature (991)..(991): n is a, c, g, or t
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaaaaatttgttggggcggttgggcttgagagaaggtttttaagagacaatttggttggggggggggggccattggtgtagttggacccttgggcataaggtggttcctaagggagactctgggcaatggacatagtggggtgggtttctcccaattaaaaaacgggcgggggaacccggggtttggaaaaaacttgaagagggagcttggagggcccaatgaggggccttttatcaacggggggggtttccaaggggagctccaaaaatcaaatatccgcccgcggtgggggttgnaccacataacactatataaccaatactaatctactacaaacaataaacaccacctatgataacacaccacatatacacactacaccttcacatacatcatataccactacatcaaacatctattcaacacacatacactatcacacatacactacctacaccatatacacaaaatataacgattatacacattacacatagta

SEQ ID NO: 370931 - DNA, 1042 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaaaaaaaaaaaaaaaaaaaaaaaactttttcggcgcgcgcgcccgggcccctggaaaaggtttttaaaccccttccggttgggcgcgcccgcgggcgccccatttagtgttactggtagacactttggcgccataacagcgtggttccctaaggagaaactccggggccatagcgacttagtggggctgtgggtttctctccccacttttaaaagaagcgcgccgggcgggaacaccgcgaggtttgttcttgagaacaccttttcctcaggtgtggggaggtccccagagagggcgccctccggggggttctctttccaccggggggtgtcccagggaggagctctccattttccaatttagcgcccg

SEQ ID NO: 370932 - DNA, 747 bp, Homo sapiens
  misc_feature (21)..(21): n is a, c, g, or t
  misc_feature (26)..(26): n is a, c, g, or t
  misc_feature (28)..(28): n is a, c, g, or t
  misc_feature (315)..(315): n is a, c, g, or t
  misc_feature (321)..(321): n is a, c, g, or t
  misc_feature (331)..(331): n is a, c, g, or t
  misc_feature (335)..(335): n is a, c, g, or t
  misc_feature (346)..(346): n is a, c, g, or t
  misc_feature (350)..(350): n is a, c, g, or t
  misc_feature (367)..(367): n is a, c, g, or t
  misc_feature (372)..(372): n is a, c, g, or t
  misc_feature (376)..(376): n is a, c, g, or t
  misc_feature (378)..(378): n is a, c, g, or t
  misc_feature (382)..(382): n is a, c, g, or t
  misc_feature (385)..(386): n is a, c, g, or t
  misc_feature (389)..(389): n is a, c, g, or t
  misc_feature (393)..(393): n is a, c, g, or t
  misc_feature (399)..(399): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (420)..(420): n is a, c, g, or t
  misc_feature (428)..(428): n is a, c, g, or t
  misc_feature (439)..(439): n is a, c, g, or t
  misc_feature (450)..(451): n is a, c, g, or t
  misc_feature (455)..(455): n is a, c, g, or t
  misc_feature (480)..(481): n is a, c, g, or t
  misc_feature (492)..(492): n is a, c, g, or t
  misc_feature (497)..(497): n is a, c, g, or t
  misc_feature (502)..(502): n is a, c, g, or t
  misc_feature (508)..(508): n is a, c, g, or t
  misc_feature (512)..(512): n is a, c, g, or t
  misc_feature (525)..(525): n is a, c, g, or t
  misc_feature (537)..(538): n is a, c, g, or t
  misc_feature (540)..(540): n is a, c, g, or t
  misc_feature (542)..(542): n is a, c, g, or t
  misc_feature (545)..(546): n is a, c, g, or t
  misc_feature (552)..(552): n is a, c, g, or t
  misc_feature (565)..(565): n is a, c, g, or t
  misc_feature (567)..(567): n is a, c, g, or t
  misc_feature (571)..(571): n is a, c, g, or t
  misc_feature (575)..(575): n is a, c, g, or t
  misc_feature (577)..(577): n is a, c, g, or t
  misc_feature (579)..(579): n is a, c, g, or t
  misc_feature (585)..(586): n is a, c, g, or t
  misc_feature (592)..(592): n is a, c, g, or t
  misc_feature (600)..(600): n is a, c, g, or t
  misc_feature (611)..(611): n is a, c, g, or t
  misc_feature (641)..(641): n is a, c, g, or t
gcccttccttggtgcactacngagangnagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacaaaaaaaaaaaaaaaaaaaaaaatngggggnggagggccangganaaaaaaaaaantttncttgcggccgaatttcnggctnattngnccanttnnccntatngggagncgttaacattnaanggnccgnggtttaanaccgtggggangggaaaacccnngggntacccaattaattggttggaagaanntccccttttgncaggnggggnattacnaaanaggcccacccgtnggcctttccaannantngcnnaccctnatgggaatggaantngaangctnantntttggnnaaaatncgggtaanttttggtaaanaacttatttttaaccaataggccgaatggnaaattcctttttattaaaaggaataacccggaatagggtggagggtggtccagtttggaaccagaagccatttaaagaacggggcttccgaggggccgcattgggg

SEQ ID NO: 370933 - DNA, 1382 bp, Homo sapiens
gaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggcgaaacaacctgaccacactgcgcacgcgtttcctttgagcactgcattctgggtaaactgtctcaaaaatttgaagagcgcatgcgtgggccagcttcttccttttacctcgttgcactgctgagagcaagatgggtcaccagcagctgtactggagccacccgcgaaaattcggccagggttctcgctcttggtgagaaatagtttgtgattttggggaagcgttgccgtggagcgctaggctgcttaaaatctcaagtagaggaggccacgggcggcacgagggagcacgccgactgggagtcgctggtgccgccattacaggcctgtactgtggcttgggagtcccgggatgcgggtagtagccgtctgagtgcggagtcttgtaatttctatgacctgcaaaaccgctgtctcttttcttacagtcgtgtctgttcaaaccggcacggtctgatccggaaatatggcctcaatatgtgccgccagtgtttccgtcagtacgcgaaggatatcggtttcattaaggtaggcgtctgcaggcgtactccatgttgtttgggcagagaaggttgtgggggttattttttccgcgaaagacaaacggacagatcttccctggagtggtaattctgagcattcgaccaagagcttttcctctttttttagttggtagctggtgacagtgttgatggtttgggcaatcaaattaatagaatggagaaggtgaaggacttagtctttcctactcccttttttacctagatagcttagccagttttaggtgccgtgtattgtgtttggtgaaattcactttagagaagccactaaaattgttttacattgtttcatttatcaatcttgtaagtacctattctctttttttttttcttagagatagggtctccctctgtcgcccaggttgaagtgcagtggcgttgttacggctcactgcagcctcgaactcctcctggtctcaggcgatcctcttgccttggcgtcccgagtagctgggactaaaggctcttgccaccacgcgcggctgtacctagatattttctaaccaaatatatgtattaaccgctgaccccaagttt

SEQ ID NO: 370934 - DNA, 413 bp, Homo sapiens
cagatgccagtactttgttttgtgtacagccggcaggaccatgagccaattaaacctctttataaattacccagcctcaggtatttctttttagcaacacaaaaatggcctgatacaattccctttgttccaatgtgaatagaaaattgagatgtttctggccaggcgcagtggctcatgcctgtaatcccagcactttgggaggctgaggcaggaggatcacgaggtcaagagattaagaccatcctggccaacatggtgaaaccctgtctctactaaaaatacaaaaattagctgggtgtggtggcgcatgcctgtagtcccagctactcaggaggctgaggcaggagaatcacttgaactgggcaggcggaggttgcagtgagctgagatcatgccactgcattccagcc

SEQ ID NO: 370935 - DNA, 266 bp, Homo sapiens
gttgtaaattttgtccatggatttattcgttcgcctctctagctgtgctttctatttttatgtgaggattcagggaaatccaaaaactatgctgctaccagcaccaccatcttctaggcatccagtgacttaatcttgaaagctagatcctgaaagcatgtctttaactggtttgaatggacattgttggtttgagggaaaagatggggattaaacctcaagctaaaatcagattgtactgctttgcattgtgccctgaccaaaaa

SEQ ID NO: 370936 - DNA, 435 bp, Homo sapiens
atgaaataatctgcacaccaaacccctgtgacatgcagtttacgtatatgacaaacatgcacatgtacccctgaacctaaaattaaaaaacaaattaccaggactgaatctatatgaaggcaggaattcagagagagaagcagagtattaaagactgcttttcttctgaggacatttgccacattctgaggagcttttactttgcttttgaaggcctcacaaggcacaggatatagaaatggaagcccaggatggcccaaggtggggagtctaataagaaattccttccctataaaactgagactccaaagagccatgcctgtagagtatgagcgaaccaaaattaaaaccctgctatgctcttgcccacaggaggctgcaagaaaagttgccttggacctaaaaaaaaaaaaaaatacttcttcgctcctaagt

SEQ ID NO: 370937 - DNA, 532 bp, Homo sapiens
gattgccaaattaataaaagcctagtcgtatatgaatttatattgtcaggatgttgtctttggaccctaattatgctaatgcagttgtaatactaaatttgaaatcaaaagaaattctaaaatataaaagggaagctaagctaaaacagtcctgcaacagactacaatcaccggtaaaaaacagttttcggctaacatcgagatagagagaatgacttttacacacgttgttctgcaatccagagaaattctaatctttaaaggattttaaatccaagagatataactaggcagtcatgggacccattccactagccaaaattcacctctctaaagcagtcacagcttatacagtgtaatagaattgacagatgtcagaccctggtgagggaatataatcattgccaaaccttcctgaaaggaacttttgctgcaagtgttggggacaagtaattcaagatgtaaaatctgcagatagccccaaagtgtcattgtctcctcaggctccacagcactttctgggaattaaaaa

SEQ ID NO: 370938 - DNA, 293 bp, Homo sapiens
cctaaaaagcagtttgggcagctctaatgcacttgtatttctgatggcagatgactttaatccctagttttccccaaccatcagtcactcttatatgtcctttctcaggacttccagaaatcattttctaaaaagccacgtgaactactatgattatgccaccagacactatttagataaatcctcagagtttattcaggtagtttcagttgctgtcttgccattctgttttctgcccctgtatcatgtcaattattagatttttaataacatagcagaaaatgagttgcctt

SEQ ID NO: 370939 - DNA, 672 bp, Homo sapiens
aggtaatgtgcaaatactgtgccattttatatcaagtacttgagcacctgcaaattttggtatctgggagggtcctggaaccaataccccgaggataccatgggacaactgtagtacatgtgtagtccatgtatgcatgtgtgaatccaagcaaacattgtataaaaataataatggaaagaacaggcttggtgcggtggctcacacctgcaatcccagcactttggaattgcaggccaacacgggaggatcacttgaggcctggagtttgaaatcggcctgggagatgtaccaagaccccatctgtacaaaaaaaaaatttagccagatgcgatggtatatgcctgtgaggcccagctacccacgaaattgaggtgggagattgcttgagcttaggagttcaaggctgagacgggccatgatcacaccactacattccagcctggttgacaaaatgagaccccatctctaaaaaaagaaaagaaaaaaagaacagtctactaacaaaacgaaaatactggacaataatcctctctaagttgggagaaggataattagagttacagtgttctgggtctttttattttggggagaggggttaaaatattgcttaacattaggtcttcttatgttgaaattgcattaaaagtgattagccatttaaaagtgaaa

SEQ ID NO: 370940 - DNA, 596 bp, Homo sapiens
ccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagtgagcatttaaaattttttaactcacagtgagtctgctttatggaatgctgatgtaaaggatgattttttttaattgggattaatttgatattcttaaatgatgttaaattcttcttaccacttctgtgttcctgagactttcttaattaaaaaaattatttatatt

SEQ ID NO: 370941 - DNA, 309 bp, Homo sapiens
  misc_feature (192)..(192): n is a, c, g, or t
  misc_feature (233)..(233): n is a, c, g, or t
  misc_feature (281)..(281): n is a, c, g, or t
gcaatacaatcaatcacctttattccgggttagaacaaggccgtgcacactgcagacagaagagcacaagataggggcaatctcacagcagagtctagtagtttctctgtaaggcaaaataatctaaaaagactaacctgcccacccactccttatattgctgtggcaggttagtctttttagattattttncttacagagaaactactagactctgctgaacgagacgacangggttctcttctccgtcgcccgaacttccttgcaagccccggggggantccacctaagttctaagagccgggcccc

SEQ ID NO: 370942 - DNA, 266 bp, Homo sapiens
ttttacaaaaaatttcccactatatcctaaaaagtcggaattctgaaatagactggactcagacaccaactaaaggcagcatcactcatcactccccagcttttagtcacaagcagctaaatattctcctctaaataccaagggatgacaacccgaagctgtgagaggggaagagacctgatttgacaacaggatgaacagaactcaggcaaactaagttccagtttttaacaacgtaaaaaatatgatcgacacaaagacaaaat

SEQ ID NO: 370943 - DNA, 2481 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370944 - DNA, 2316 bp, Homo sapiens
aacagaagaaaaagatggtggggggaaggagtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370945 - DNA, 2351 bp, Homo sapiens
agagccggtacctctctccagactggctctctccacactggagctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370946 - DNA, 2332 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370947 - DNA, 2466 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaagctaacccgtatccccagtgccaagaagtacaaagacattatccggcagccctctgaggaagagatcatcaaattggctcccccaccgaagaaggcctgagcaagggggaggacgaggagggaaggttggaccttcatcagaccactcccttcccccatcctccaggagagggggcaagggcaacccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370948 - DNA, 2099 bp, Homo sapiens
  misc_feature (14)..(14): n is a, c, g, or t
agggaggacaatgnaggctaggtacgaggcctgggtgttatcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctgaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370949 - DNA, 1678 bp, Homo sapiens
  misc_feature (14)..(14): n is a, c, g, or t
agggaggacaatgnaggctaggtacgaggcctgggtgttagaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370950 - DNA, 2829 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaactaactgattttaaaatttctgtgagtgaccaggattttgcaggctttgaatcactgggaagggagggggaacaatatttatggcccagaataagggctgggaaaataccccaagtgtataccctcaccccacccaatctcctaagtatcactgagctaaatggagtgtatcctacttccaacagtctccaattggagcccaagcactggaaatacgggtctcccaaaatggactttctaacactgtatcatgtgcagaatgagaggggaaggctaggtacctacattagtaggaacaaaaaccatccattgtgaataaatggaccacataccacacagagcagcagt

SEQ ID NO: 370951 - DNA, 1493 bp, Homo sapiens
  misc_feature (26)..(26): n is a, c, g, or t
cggacgcgtgggtcgacccacgcgtncgagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370952 - DNA, 1537 bp, Homo sapiens
cgacttataacgcgtgtgcactggccgtcgtatacgggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370953 - DNA, 2229 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggagagatatgagcgtaacatgggccgagctcga

SEQ ID NO: 370954 - DNA, 1261 bp, Homo sapiens
agctcggtacccgttggtcgatcatctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370955 - DNA, 2157 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccagagattgcccctatcttgtgctcttctgtctgcagtgtgcacggccttgttctaacccggaataaaggtgattgattgtattgcaactaa

SEQ ID NO: 370956 - DNA, 2338 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtggttagacagttcttttaagttgtaggtgaaataaagggtgaatgcctttatggtgaatggtgatgcgccaggctaacacagatcgcctggttggtctcttagttttgcctttaaggaccttaccagggatccgtttacttgcctgtgttctccctttataaggtacagaaacttgtgaaatttgggggaggtggaaggggatgaaatgggcgtactgtggggatttgttccataagatggaggaaagtggatatgtcaccccgttcttgtggttgaacacggttagaacaataaacagtcttcctttttaatataagtctttgcgtgttctttgtcaagaagaataaatctaagttggattattcttgggaaccccctttc

SEQ ID NO: 370957 - DNA, 1443 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttcaaactcaccgtctctctaaccacgagccgtcgtttacaactggccgggcgtttacagctggcactgttatacatctaaccctcagtttaccctgacctcgttatactcgcactcgttacc

SEQ ID NO: 370958 - DNA, 2476 bp, Homo sapiens
  misc_feature (14)..(14): n is a, c, g, or t
agggaggacaatgnaggctaggtacgaggcctgggtgttatcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370959 - DNA, 2463 bp, Homo sapiens
agcggggccgacgagtctcttctgcattcacactgtctttctgcctggccctccgccgatgccatgagcagcggcggcggtaaacggtcggccggtgcggacgggagccgagagagttccggacgctgttagaaccggactcaggatgcccgccctgacgctcactccagcgttgtgatcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370960 - DNA, 2410 bp, Homo sapiens
  misc_feature (14)..(14): n is a, c, g, or t
agggaggacaatgnaggctaggtacgaggcctgggtgttatcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagaacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370961 - DNA, 2171 bp, Homo sapiens
  misc_feature (14)..(14): n is a, c, g, or t
agggaggacaatgnaggctaggtacgaggcctgggtgttatcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370962 - DNA, 2988 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaaaaaaaaaaaaaaaaaaaaaaaaaaaaaaaaaaaaaaaaaaaaaaaaaaaaaaaaaaggggggccgaaaaaaaaaattttaaaaggaggcaacaaacaacagaagcacccaagaacacaaaacaaaaggagcacaaaaaagagcgaacaaaaaaaaaaaaagaacaggcaacggcgaacaaacacaacaaacgacaacaacgaacacgagaaaacaagagaaaaaacaaacaccagagaagcacaaaaaggaaaaagacaacaacaagaaaaaaaacccacagacgacaaaaacacacaccacaagagaccaacggcgcgacaaccacacgccaaacaacgagaaaaaaaacctggcacacacgcacagaaatagaacacaataaacccggcacaggcggcacaaaaacaagaacacagaacacgcacacaccacccacggaaaaaacgaacgacaacagagacacaagacaagccacacacaaaacaaggaccgaacccaaaagacg

SEQ ID NO: 370963 - DNA, 2484 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcactcagtctggacccggaataagtgtggtaccgggggtccggggggggggggg

SEQ ID NO: 370964 - DNA, 1752 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcc

SEQ ID NO: 370965 - DNA, 2064 bp, Homo sapiens
agcgggacatcaccggccagccgggtggagtgagcggcgctgggctcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcaagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 370966 - DNA, 455 bp, Homo sapiens
  misc_feature (14)..(14): n is a, c, g, or t
agggaggacaatgnaggctaggtacgaggcctgggtgttatcgggctccggctccgcgggcggaagaggcggcggcggcggcagaagcggcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaaggagattgcccctatcttgtgctcttctgtctgcagtgtgcacggccttgttctaacccggaataaaggtgattgattgtattgcaactaa

SEQ ID NO: 370967 - DNA, 2052 bp, Homo sapiens
ctgtggatgtttttcgaaggataattttggaggcagaaaaaatggacggggcagcttcacaaggtcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagttgttgtttaaaataatgtaatcatcaaaatgatgcatattgttacactactattaactaggcttcagtatatcagtgtttatttcattgtgttaaatgtatacttgtaaataaaatagctgcaaacctcaaaaaaaaacattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggatcacgaggtcaggagttcgagaccagcctggccaatatggtgaaacctcgtgtgtactaaaaataaaaaaattagccgggtgcggtggcatgtacctgtagtcccagctactcgggaggctgaggcagaagattcgcttgaacccaggaggtggacattgcagtgagcagagatcatgccactgtactccagcttgggtgacagagcgagactgcacctcaaaaaaaaaaaagtaattcaggggatcctagtggccagcttccttggctcgtatactggctacaacaagtagttttgtggtgatttgtggaaacagattcttgggagcatatcagagcatctcagcattgattggcacatccatagttgttaatgtaggaagggtgaccagcagctcagcacagtggcttgcttccagcactctgggaggctgaggtagaggattgtttgagaggagttcaaaaccagcccgcgagacatagtgagaccctgtctctacaaaaaattct

SEQ ID NO: 370968 - DNA, 460 bp, Homo sapiens
tggccctgccctcgacagccttgctggtggtcgtgaaggctctaaacacctgcatggcaatgaggccaaccttctccgcttgatccgtttcaggctctggctccgctactgcatcgtgtgcttctgtccaagaggcagagagactgaaactatctgctgccgcctggattctcccagagattgcctggaacaccagctcgggtcctcgcacaccatcctggtaggaatctctcagtgacaattgagagtttgtgggctggcttagggccagtggtgggcagggagtcagcagggcgcaagggactggagagcttggcatttctccaacaggagtttcagggagagctcagaggcctgcttatgtgacaggtttatcagcttgcctggcccagggccggctctcataccgttttgatttaaataatagattgctcacagaataaatgtatgttggtttaag

SEQ ID NO: 370969 - DNA, 224 bp, Homo sapiens
ttacaacagctccagttacaacagctataataggtgtgagccactgcacccggccaccattatcttttgaatcctctcttcctcctgcccaccatgaatttacttcctctcacccatctccctgatattgtaattctggttagatcatattcagtgtcaaattattaagatgtgattaaactttttaaaaatatgacagtgtcatagtgatcacagctgagtca

SEQ ID NO: 370970 - DNA, 1206 bp, Homo sapiens
taggtgtaagccctgatcccgcccagtgcatccccgaggccccaagcaactctcctccaactgtctttagggataaccctgagcgggcagcgtctactctatacctaactttatccgtaccagatacctagcctcactcagggccccccttacctggcggtgcgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggtttttaaaaaaaaaaaccacccacaaaacaaaagcaaaggaacacggggcg

SEQ ID NO: 370971 - DNA, 1260 bp, Homo sapiens
taggtgtaagccctgatcccgcccagtgcatccccgaggccccaagcaactctcctccaactgtctttagggataaccctgagcgggcagcgtctactctatacctaactttatccgtaccagatacctagcctcactcagggccccccttacctggcggtgcgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggctctggctccgctactgcatcgtgtgcttctgtccaagaggcagagagactgaaactatctgctgccgcctggattctcccagagattgcctggaacaccagctcgggtcctcgcacaccatcctgcgggtgcagcccagaactgtcttctgaggaagaggtgctctcctgggcccccactgtccccaggcctcaggtaagcccatcaggg

SEQ ID NO: 370972 - DNA, 1415 bp, Homo sapiens
taggtgtaagccctgatcccgcccagtgcatccccgaggccccaagcaactctcctccaactgtctttagggataaccctgagcgggcagcgtctactctatacctaactttatccgtaccagatacctagcctcactcagggccccccttacctggcggtgcgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggctctggctccgctactgcatcgtgtgcttctgtccaagaggcagagagactgaaactatctgctgccgcctggattctcccagagattgcctggaacaccagctcgggtcctcgcacaccatcctggtaggaatctctcagtgacaattgagagtttgtgggctggcttagggccagtggtgggcagggagtcagcagggcgcaagggactggagagcttggcatttctccaacaggagtttcagggagagctcagaggcctgcttatgtgacaggtttatcagcttgcctggcccagggccggctctcataccgttttgatttaaataatagattgctcacagaataaatgtatgttggtttaag

SEQ ID NO: 370973 - DNA, 2080 bp, Homo sapiens
taggtgtaagccctgatcccgcccagtgcatccccgaggccccaagcaactctcctccaactgtctttagggataaccctgagcgggcagcgtctactctatacctaactttatccgtaccagatacctagcctcactcagggccccccttacctggcggtgcgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggatcacgaggtcaggagttcgagaccagcctggccaatatggtgaaacctcgtgtgtactaaaaataaaaaaattagccgggtgcggtggcatgtacctgtagtcccagctactcgggaggctgaggcagaagattcgcttgaacccaggaggtggacattgcagtgagcagagatcatgccactgtactccagcttgggtgacagagcgagactgcacctcaaaaaaaaaaaagtaattcaggggatcctagtggccagcttccttggctcgtatactggctacaacaagtagttttgtggtgatttgtggaaacagattcttgggagcatatcagagcatctcagcattgattggcacatccatagttgttaatgtaggaagggtgaccagcagctcagcacagtggcttgcttccagcactctgggaggctgaggtagaggattgtttgagaggagttcaaaaccagcccgcgagacatagtgagaccctgtctctacaaaaaattct

SEQ ID NO: 370974 - DNA, 1641 bp, Homo sapiens
cccccccccccccaccccagcccactcccgctcacggatccttaattaaattaatccccccccccccccccctggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctaggtatcttttgccatctttctctttagatcaggggaaatgtttaagctaaataaatctggggggttttttgttctgttttgttttgttttctttgagaaaataaggactttgtgttcatttgaagtttgctttggctaaattttgacaccctgggggatgtcctgggagaatgccagtactttgaaatagcacagctattgatgagattttaagctgctgttcctggccagttgcaggttaagccccagaaaagttcaccttggagaagctccgagaacacacagattgtgtctcattcatcttcagacacaggcacatagtgtggcactttgttcagttaacatttgtggagctgtcatcagctcagctttaacaacacaggtgactctttcccttgataaagtcataggtaattcaggggctgggtgcggcggctcacgcatgtaatcccagcactttgggaggccaaggcgggcggatcacgaggtcaggagttcgagaccagcctggccaatatggtgaaacctcgtgtgtactaaaaataaaaaaattagccgggtgcggtggcatgtacctgtagtcccagctactcgggaggctgaggcagaagattcgcttgaacccaggaggtggacattgcagtgagcagagatcatgccactgtactccagcttgggtgacagagcgagactgcacctcaaaaaaaaaaaagtaattcaggggatcctagtggccagcttccttggctcgtatactggctacaacaagtagttttgtggtgatttgtggaaacagattcttgggagcatatcagagcatctcagcattgattggcacatccatagttgttaatgtaggaagggtgaccagcagctcagcacagtggcttgcttccagcactctgggaggctgaggtagaggattgtttgagaggagttcaaaaccagcccgcgagacatagtgagaccctgtctctacaaaaaattct

SEQ ID NO: 370975 - DNA, 1368 bp, Homo sapiens
taggtgtaagccctgatcccgcccagtgcatccccgaggccccaagcaactctcctccaactgtctttagggataaccctgagcgggcagcgtctactctatacctaactttatccgtaccagatacctagcctcactcagggccccccttacctggcggtgcgggatcaacaaatgaaattgtgacgggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcggaggcgagaccgcgctcaacactggggaaaggaaggaggcgggccctgcgcgcagcattttgggaaagagtggaattctgggtgttaggcccgccattcgcttgactcacgccttcgccgtagcatctttcgcagcggaccgaagagaagaaaagtaggccagagccgaactctcttcctgccaagatgtctattggtgtgccgattaaagtactgcatgaggccgagggccacattgtgacatgtgagacgaacaccggtgaggtatatcgggggaagctcattgaagcagaggacaacatgaactgccagatgtccaacatcacagtcacatacagagatggccgagtggcacagctggagcaggtatacatccgtggcagcaaaatccgctttctgattttgcctgacatgctgaagaacgcacccatgttaaagagcatgaaaaataaaaaccaaggctcaggggctggccgaggaaaagctgccattctcaaggcccaagtggccgcaagaggaagaggacgtggaatgggacgtggaaacatctttcaaaagcgaagataattttctaagttgaacagaactttgtccttttttctttcaggttatctgagttcattggagtgggtgcttgtgcatatatgctagagacagggttttgccgtgttgcccaagctggtcttgaactccggggctcaagtgatctgcccgcctcggcctgctgggattataggtgtgagccactgcacccggccaccattatcttttgaatcctctcttcctcctgcccaccatgaatttacttcctctcacccatctccctgatattgtaattctggttagatcatattcagtgtcaaattattaagatgtgattaaactttttaaaaatatgacagtgtcatagtgatcacagctgagtca

SEQ ID NO: 370976 - DNA, 209 bp, Homo sapiens
gcctcaaaagaaatttagaaaatgatctttctccagttaatattgctaacatccaaaccagataaattcaggataaagagaaatctactttgtcccctgaattgatggtacttggaacagaccatgtactcgccaactcttccctttcctttggactctgaacctgtcctaaggcaatatgtcttccccaaccttccttttttcctaaa

SEQ ID NO: 370977 - DNA, 2132 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcggggggggtggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaaaaaaaaaaacga

SEQ ID NO: 370978 - DNA, 680 bp, Homo sapiens
cttcatttgggaatattttacatatcaaactatattcattaataatatattcccccaagtcttattagtcaaaaacattttttaaaagcatgattttcatcaccatggaaataactagcttgattccagccaaaagctgagatttttgttatttcagttagtctgtgcaaatttattgtgggtaaacacaggagttccattttgcattcttttagaggcctgggccatcagattttaaaaaggtatgaacttaaaaaggtcaaaattcatgttgggaagactcaatcacaggataagcttgctaacaacagttaagaacaatggaaggaaaccaccaaaggaatggtctccaatgatggaaaatatgataaggtactgacaaatgacagctaaacagcagcaaaatttctaactcctatcatttctgccttctttttccagagaattatctatctagaaaaggtagaagacgtcatcaagaggaaaatgatgcctctaagcttgggactgcatcttccccactcttaatcctccttctataggaaggaatcttcacgagcacagcatccctcacttctgtctgctgcctcacctatcccatcccataaaaggaggtggatgctcatcttttcagtctttctggtgactttgcaaaaataaattgaacacattaacccttt

SEQ ID NO: 370979 - DNA, 297 bp, Homo sapiens
cagtttggagacaattcattgaacattgatttaatgactaagctcacataggaagaagagaattatctatctagaaaaggtagaagacgtcatcaagaggaaaatgatgcctctaagcttgggactgcatcttccccactcttaatcctccttctataggaaggaatcttcacgagcacagcatccctcacttctgtctgctgcctcacctatcccatcccataaaaggaggtggatgctcatcttttcagtctttctggtgactttgcaaaaataaattgaacacattaacccttt

SEQ ID NO: 370980 - DNA, 2750 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcggggggggtggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccggtaagcaaattgggaattttaaattatcaaaaatttttttttcctggtattgtagcctggtatggtcttgtggtcttggattgaacaaatgttcactaaacaaacatgcattaattatcttctactgtgttgaaatggtattattataggagtttgtttggcaagaatgagtattccagtgcctggccactctgaacatataaatttgattactcaaacatccaaatggaggaccacatcatcagctgctacttgaagtggccagtctgtgcccaactactgaactgttcagagcccacagaaagggctacggtagagacatgtatggtatctcgtatacacaggcatgccttatttctttgtcttctaccccagtgctacctacctaaagacctctggtactcttccctttcctgggaaagaaattcaatcttgttttctcttttattattgtattctctattctacagttatgccccaatagtagccaaaggaaaaagggggaagatgatagtttgactaaacaaataccagttcatacattcttgttccaataggagttatgggaggaaaaattattccaagcaatcacacaggatcaactttttctccttgtagaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaaaaaaaaaaacga

SEQ ID NO: 370981 - DNA, 806 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcggggggggtggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctcatccagttcttcaaagtggaaaaacaattaaaagcatttcctatcagatcagtaccaactgtagcagacttcagaacaaggtctctgggaaatttaagcggagaattatctatctagaaaaggtagaagacgtcatcaagaggaaaatgatgcctctaagcttgggactgcatcttccccactcttaatcctccttctataggaaggaatcttcacgagcacagcatccctcacttctgtctgctgcctcacctatcccatcccataaaaggaggtggatgctcatcttttcagtctttctggtgactttgcaaaaataaattgaacacattaacccttt

SEQ ID NO: 370982 - DNA, 2080 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcggggggggtggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggaatatgtgtcatcacattggcagaatctcatccagttcttcaaagtggaaaaacaattaaaagcatttcctatcagatcagtaccaactgtagcagacttcagaacaaggtctctgggaaatttaagcggggggcacagtttctaacagagcttgcacctctctgtaagatttactgctcagatggtgaagaatatactgtgtctagttgtgttagaggacgtttgatggaagtgaatgaaaacatcctccataagccatctattcttcaagaaaagccatctactgaaggctacattgcagttgtgttacccaaatttgaagaaagtaaaagcataacagaagggttactgacacaaaaacaatatgaagaagtcatggtgaaacgcattaatgccacaacagctacgtcatgaggattgacatggaacaaaaagcaaagtgggattcttgttacctggcctaaaccatcagggtactaaaggagaagaaccagtatatgtaaagcatacctaacagccagccatatgcaggggaggcctagtgcttcacttagttttccctctctgtcttcataatgagccttggttcccatttgtctacagcctgccagatctggcctgcccatgtactcacactgttctcttgcatctctctaacaactggcatgcaaggcatgtttttctgattaaaaacaaacaaagctctttgaagaagatttagaaaatacagaagagttttaagtagccaagtaaaaataatttacccatcatcccataatccagaagtaaatacatttgacccttgagcaacataggtttgaactgcaagggtccacttatgcatggactattttcaactataaacgagtcaaaaatatatcattaaccaaacacgaaacccacttatagagcaggttcatatactcaggttccaaagggccaactgcaggacttgagttctcacgtatggatttgggtatatgtggaagttcctggaaccaatcccctatgtaaaccaagggataactactacattttaacctacttctgtttgaacatatggtatggttattgcttttgcctcgttttcctaacagtttgaagtttaaaaaaacctaacccacctttcttacccagtcttctataatgtgcctaccaaaaagcctagtcctagcccatctgcctcaactcctctcccttttaggttgtagggaagaggccggagtgtagagtatattatatcttctgtcccccttatgccaacaagatggccttcccctctgaaacaaagtaaaactgcaacactgtgacttcttaaatgagggatatgtgaaaaggctatgaaaaatacaaaggctttcctaggaaatgtgttataatgcagcgggaagctaattcttgaaatatgcacattatagttactcagtctcacatactctagttactggcaaagaagttactgagaatatgtcattcaaaggcataggggcctttgaatggaacaaatgctttcacatcatttaaagtaaaaaaaaacctccaacaactgtgaatttatagtttaagagtgatttacactgaatttcaaataaaaggactataaaacgtgttatttttctgtaagggctataacatacatgtcaatatcactgtttttaaataaaatatacttttatacagaaaaaaaaaaacga

SEQ ID NO: 370983 - DNA, 1607 bp, Homo sapiens
cttacggcggccggccttctttgtaggcctggcaccgtagaggtagaggagctacattggccgcgtcccctgtccctctgccctcttgcccatctgcccaaacttttgtatttgatctctgttttgatgtcgaaccccaaagcactgtaattggggggggcggggggggtggtggaacctgcggacctgagagcagcgcgcgtgcgcacgacacgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccggtaagcaaattgggaattttaaattatcaaaaatttttttttcctggtattgtagcctggtatggtcttgtggtcttggattgaacaaatgttcactaaacaaacatgcattaattatcttctactgtgttgaaatggtattattataggagtttgtttggcaagaatgagtattccagtgcctggccactctgaacatataaatttgattactcaaacatccaaatggaggaccacatcatcagctgctacttgaagtggccagtctgtgcccaactactgaactgttcagagcccacagaaagggctacggtagagacatgtatggtatctcgtatacacaggcatgccttatttctttgtcttctaccccagtgctacctacctaaagacctctggtactcttccctttcctgggaaagaaattcaatcttgttttctcttttattattgtattctctattctacagttatgccccaatagtagccaaaggaaaaagggggaagatgatagtttgactaaacaaataccagttcatacattcttgttccaataggagttatgggaggaaaaattattccaagcaatcacacaggatcaactttttctccttgtagaatatgtgtcatcacattggcagaatctcatccagttcttcaaagtggaaaaacaattaaaagcatttcctatcagatcagtaccaactgtagcagacttcagaacaaggtctctgggaaatttaagcgggtatgttcctgtaattctgtgattatctacttacatcctctatattcatggtaatgacagatccaatgaaccttagaatccagtagcatatgcttagcatacttctctagcagtttgaggtgctaattttaggtatactttcacctaaagaaattctcagctcccccaaattaggtatctcaggaggtgtagtatctgttatattaggttctgtgctactatccctataatgcccaggatggaggagggggaaggcaggcctttgaaaggagaactctaatagcaatataacaagatattttgtcccttctagttgtattaaactagtatgtcgagttctgtaaaatttaggtgactaactcttctttaccatatatttccacatgtaaattaaacagaaaaaaaattcccaagggagttag

SEQ ID NO: 370984 - DNA, 736 bp, Homo sapiens
tctcacccttctgtgtctcctcaaactttctaagatactctaagatatcttagacattcaggacaaaaagccaagacacactctgccacctacaaatatccctaaagagttcaaccttgttaactgcttgaaaggatcaagaaaaaggagggaaaaatagaagaaaagacactaagccaatacagtccccaccccttataattcctggttactgatgtagtcattatgtcattaacatactgtagttattactacattatgttactatgtattaggctgtctaggtgaggctgagaaacacttgatgacagtatttggtatcctccagaatatactgggaatacggttccaataacacataggatggttcctcggccactctgagccatcgtcaatgaatccctgtgaacactcctctagcttagttatgctgttcttttaagtttgtctttgagttgggaaagtagacctatttggcttggcttaagggctaaatgtctcctcttcacttggtcttctaatcctcagtccttcctggctatgtggcatcatgtctttaaagcagggagagtaaagtatcaatattttaagaaggaacattcttcccacttacgttttctattcttctttcttttgagccctttctagaaagagtaatgctctagccttcaaccagaaatgaaaagtctatcttcaaatggtttaaacttttcatatatgccttcatatatgtgtc

SEQ ID NO: 370985 - DNA, 2495 bp, Homo sapiens
agcgtcatcattgcctccttcagtgcagcaaaagatacttgcaactgccaccaccagtacctcaggaatggttgaggcctcccaaatgccaaccgttatttatgtatctcctgtaaatacagtgaaaaatgtagttaccaagaactttcaaaacatttacccaaaacctgttacagaaatagcaaagccagtaatactaaataccacacaaattccaaagaatgttgctacagagacacaattgaaaggtggtcagcattctcaagctgctccagtgaaatggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtttctcctgatactccagtaagaaaagacacgttacagacagtgagttcaagtccagtcacagaaatatccagagaggttgtaaatattgttttggctaaaagtaaatcttcccagatggagacaaaatcactttccaatacccagcttgcttccatggccaatctaagggcagagaagaataaagtggagaaaccatctccttctaccacaaatccacatatgaaccaatccagtaactacttaaaacagagtaagactttattcacaaatccaatctttccagttggatttagtacaggacacaatgcccccagaaaagtaacagccgtcatttatgctagaaaaggaagtgtcctccagagcatagagaaaataagttcctctgttgatgcaacaactgttacttcacaacagtgtgttttcagagaccaagaaccaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttggggactatgtacatacgttactgagattgtgtaaaaagtagatcctgaacagttatcacatttaatatttcttaaactgtaaaagtgtattttc

SEQ ID NO: 370986 - DNA, 1919 bp, Homo sapiens
gttttgcagtctttcactttaaaaactcaaaatggaaaattatatactttattttaatatttacaaatatttacaaatatttatttttaaataaaatgtatataccatgtagtatgttgtatttatttactcaatgttcttttaagtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaagatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttggggactatgtacatacgttactgagattgtgtaaaaagtagatcctgaacagttatcacatttaatatttcttaaactgtaaaagtgtattttc

SEQ ID NO: 370987 - DNA, 1811 bp, Homo sapiens
cagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttggggactatgtacatacgttactgagattgtgtaaaaagtagatcctgaacagttatcacatttaatatttcttaaactgtaaaagtgtattttc

SEQ ID NO: 370988 - DNA, 1697 bp, Homo sapiens
ttatatagctaataatgataaaaagaaatgtctataactttgcctactgttatactttgacttatgagtatgtcattatcatgtaatattctgaactttagatcagagactagtaaaccttttcgaatgaaaatcctccatatgtgcctgctgtgcaaaggaaaagaaaaaaacaatcaattttatatctcaggcactttacaagtgctattatatttctgtggtgagtcagtatgccttctaatacttgacttgagcaagaaaatgtgaattaggcaatttcttcttactgaatatgattaagacattttggtaccatacagtgggaaatatttccctcttgctgtagttgtcttccataaattttgttaattgtaatagctagatatttgtttctgcagacgttgttaagtttggtagtacccggtgcatttagcagtaacatttcgtttttgttttggaatgttattcaatattgcagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttggggactatgtacatacgttactgagattgtgtaaaaagtagatcctgaacagttatcacatttaatatttcttaaactgtaaaagtgtattttc

SEQ ID NO: 370989 - DNA, 681 bp, Homo sapiens
cagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgtgtttcaggctgcatgtaccaagtagttcagacgattggctcggatggaaaaaatcttctgcaattacttccaattcctaagtcttctggaaatcttataccactagttcaatcttcagtcatgtctgatgctttgaaagggaatacaggaaaaccagttcaagttacttttcagactcagatttccagctcttccacaagtgcatcagttcaattgcccatttttcagccagccagttcttcaaactattttcttacaagaacagtagatacatcagaaaaaggtagagttacttctgtgggaactggaaatttttcttcatcagtttctaaagttcagagtcatggtgtgaaaattg

SEQ ID NO: 370990 - DNA, 1757 bp, Homo sapiens
cagcgtagggctgtgagggcgcagtccaccgccaggagccttccggtttctgcgcggtgcgcgacctcgtcccgaagcctggggatacaccctctcgagagcccgctgtcgccctccgttaaggtcgaacccctcacagttgctgtgggcaactccagcccaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagatggcatcaacatcagataaaggtgcccaaggaagaaatgacaagaaagattctcaaggaagaagtaataaggcattacatctgaagagtgatgctgaatttaaaaagatatttggccttactaaggatttgagagtgtgccttactcgaattcctgaccatttgacctctggagaaggtttcgattcctttagcagtttggtaaagagtggtacttacaaagagacagagtttatggtgaaggaaggagagagaaaacagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctctttacccttaaaatgatgataccttgtattcaccattgttttttttaatgtcgtgaaataatatgtattatggcaacattatttaaacattcaaacatttctcaagaatgagcaacatttgtaactttacaatgtaattttatataatccaaaggtattttagaattcaggccatttgatgttttgtttgcttatagtgatgtgttcccaggcaaatgctgctttttttttttttggggactatgtacatacgttactgagattgtgtaaaaagtagatcctgaacagttatcacatttaatatttcttaaactgtaaaagtgtattttc

SEQ ID NO: 370991 - DNA, 438 bp, Homo sapiens
agaacccaaaaggtccaatgagaaccgtctggctcaggcacagtgcacctcacatctgcacttcatggaccatcgttgaaaatttccaaccccggttgaacactttcatgattaagaatgcacggctgtaaggtttcagaccttgttaccacaccgccggaaccaccaaggtgctctgaaacataaaatgaacaaccactttctggtgttgactgtgtgccaggcacaatctacatgcaaaaatgaactgtcctagtgacgaccttcaaaggactcccagtggcatacaggagaccaacatggagagaggcaatcataatacaggaagcctcctttaatcagtttatttattcaacagaaatttaccgagtgcttactatgtggcaggcactgttataggtactagacatacagcagtaaatgaaacagacacaaaaa

SEQ ID NO: 370992 - DNA, 474 bp, Homo sapiens
cggtggacacgtggaggagaacaaaggggagccccaggggcatctgcagccaggtggagccgttcagccttctggcacacatctgttggctgggtggaggtatgagggcgcagatctgaaaaccaagtggtgacctagggagggaacaagcgctgtgcagcattgatgaaacttaaaagatgaagtcctggtccgggcacggtggctcacttctgtaattccaacactttgggaggccgaggcaggaagatggcttcagcccacgacaaaaaaaaaaaaaaaaacacaaaaaattagcagggcgtggtgacatgtgcctctagtctcagttactcgggaggctgaggttgggagatcagttgagcctgggaggtcaaggctgcagtgagcagagattgcaccactgcactccagcctcgacaacaggcttttggacatagcctgcctcaacaaaaaaaaaaaaaaaaaaaaaaa

SEQ ID NO: 370993 - DNA, 488 bp, Homo sapiens
attcaattcagtgggaggaagagttttctgagattagtgtcaaatggctcttataggaggtcagaaggtctttacccctggcagtttagggaaacttggcatggagcttgtgcaagggattcatgcatcaaggaggggtgggattgggctagagggcttggctggcctcttccattcccagaattctctgattctgggttccaggagggcctgtgctcttttttctaaagaaagactacctagaggaatacgccacactgtatagcaactttatgtgattgctgaggcctccccagccacctgtgatctgtgaactggcctcttgttcttgcatcttttaaataagttaatgtccatgctcttaattttggttttggatgagttattatttctagatacttaaagcaattaggccttatagtgccagtattggttaagaatagtacatcaccaaggcaggagaatcacttaaggccaggagtttgagg

SEQ ID NO: 370994 - DNA, 3247 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 370995 - DNA, 3332 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttggtggggttatgcttcctcatctcttcagtctgggtctttctaagcttcatcctgaccattgtcatcagtttgctgtaaaacacccactttatccggggctcagcacttgcctaatgaagcacacaaccttccctgcatgcatggttgtttccatctcagggcatgtcctagggaggtctctgagtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaaagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 370996 - DNA, 225 bp, Homo sapiens
tcctcggcgttctgaggatccccccttcccccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcacagtgggggaaggggggatcctcagtagc

SEQ ID NO: 370997 - DNA, 3082 bp, Homo sapiens
tcatacccaacagcacacaagaccaacactatcgtatgtgagcctgatgttaattgccagagggtacgtggtggtctccgccgcgtagagggaagcgggaaaccgagaaagaacgagggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 370998 - DNA, 3050 bp, Homo sapiens
ggggcgggcagggggcggggcccccgcgggctcccggccagggctctcggccgggctctggctacccacgtgtggagaccgggcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 370999 - DNA, 3083 bp, Homo sapiens
atatcgcacagggaaggtcctcatctctgaagatcactattcgaacttatttattatgctttctgcagagacttctcaatctgacagccctagtttggcgcggtgtaaaacgaccgcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 371000 - DNA, 3195 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatgtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 371001 - DNA, 3001 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 371002 - DNA, 2940 bp, Homo sapiens
  misc_feature (2877)..(2877): n is a, c, g, or t
  misc_feature (2884)..(2884): n is a, c, g, or t
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattatttatntaacctnttccagcaattgggctcttggttggaacacctccaaaggcccccttcctcaaaatt

SEQ ID NO: 371003 - DNA, 425 bp, Homo sapiens
tcctcggcgttctgaggatccccccttcccccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 371004 - DNA, 1075 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatgtctacctgactcctgagccaggctgccgtggtgtcatttctgtcatccgtgctctgtttccttttggagtttcttctccacattatctttgttcctggggaataaaaactaccattggacctagaa

SEQ ID NO: 371005 - DNA, 260 bp, Homo sapiens
ggcaggaaggctgtgtctctcaggctttgcacaatgactgggtggtgtctgttacaggctggatccagacccctttgtgcggcacaccttctggaccttggccttcgggggtgtcttcatgatgctctccttatacggggtgaaccaggctcaggtgcagcggtacctcagttcccgcacggagaaggctgctgtgctgtgagtgcagggacaggaagggagtggagcaaggtctaggggaaggggttccccagagataa

SEQ ID NO: 371006 - DNA, 395 bp, Homo sapiens
cctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgt

SEQ ID NO: 371007 - DNA, 634 bp, Homo sapiens
tggtccacctcaattgacagctagtaacatgttaccatgccctatctgaactggttagtcaatatcttttggtggagctctgcaaacatttttctccgttgtggtgaatgatttatttcattgttaatgaccaatgctttatctctgtggcatgacgtgattgccctaccagggcttctcccctggggaacccttttccagggataagaatgtggcttctatgcttacagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagtaagtatacccctactcctggctggggtctgcagtgcctgggcgctgagcccatcctagaggctggtcttggctatagtaagcagaaggtaaactgggaagcctgaggtgtaacagcagacagtgggaaactggtcctgcagagatggagggtgattacaggtgcccggctagtgtttat

SEQ ID NO: 371008 - DNA, 4187 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttggtggggttatgcttcctcatctcttcagtctgggtctttctaagcttcatcctgaccattgtcatcagtttgctgtaaaacacccactttatccggggctcagcacttgcctaatgaagcacacaaccttccctgcatgcatggttgtttccatctcagggcatgtcctagggaggtctctgagtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgaggggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 371009 - DNA, 3047 bp, Homo sapiens
aggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcacagtgggggaaggggggatcctcagtagc

SEQ ID NO: 371010 - DNA, 483 bp, Homo sapiens
cctgcaaccatttacccagtgttgccaaagctcctgtccctccttccgttgtcctgtcagaagcggctccactgcaggagctacggccaggtagtacctgctgtccaagtgacccctccctgcccttctccacagatgccactgactcttcaggttcccttctaccccttttctctccccctgccccgggtgcctctctcaggatcagctaagcctaggctgtcccacacggctgtctcaggttctacccacaggactgcactggcttggtgggcagaaggatctcagggctcagaggagctcagccccagcctgggccagtcagctcccctccccagcccaccctgtgctccctgctgtgctatgccctccctcttttccccctgctctccctcccgaacccagccttgctgggctcccttctggcggggaccttttttgtgtgaatcctgtcaagcacccgtcatccgtcttcaccagttc

SEQ ID NO: 371011 - DNA, 918 bp, Homo sapiens
atggagttttgcttttattgcccaggatggagtgtaatgatgcgatctcggctcactgcaccctctgcctcctggtttcaagcgattttcccgcctcagcctcctgagtagctgggattacaggtgcatgccaccacgcctggctaattttgtatttttagtaaagacgcggtttctccatgttggccaggctggtctcaaactcctgacctcaggtgatctgcccacctcggcctcccaaagtgctgggattacaggcgtgagccactgtgcccggccaggtctgtgaggttttaaaccacctgtctgtggcactttgttacggaacccgagctgagtggtacagggaggaaggccctgtggttcagcgcattttacagctgaggaaactgaggctgcagtctccatctgtgtgtcctttggttgcttgtatgagtgaggtggcaggtttgggaatgaaaccacgcctgcggtgccggggctcccaccggtaacctcccgtttttggcctcggggctccggcaggaaggagtcccaaggcttagatggaggtgcggagggcgtgtgagtgtcctggagctgctgtaacaatgtactgcaaacccagtggcttacaccctcagacgtgcattccctcacggttccggaagccggcagtctgaatcgcggtgtccctgtggctgtgacctgtgagacgggccataatcctcccagcctcttccacttccagcgggggcggcccaccctcaccttggagctgtgcctctccggtctttgcctctgtccacacatggccttctccccatgtgtctctgtctctgttttcccttcctataaggacaccagtcattggattaggggagatttgcgcacagaaacagacgtgctaactagggcatggtgagcgcatgcctgtgg

SEQ ID NO: 371012 - DNA, 493 bp, Homo sapiens
gatctgttgcaggctgggcgtggtggatcacgcctgtaatcccagcactttgggaggtcgaggcaggcggatcatgaggtcaggagttcaagaccagcctggctaacacagtgaaaccccgtcgctattaaaaatacaaaaaattagctgggcatggtggcaggcgcctgtaatcccagctactcaggaggctgaggcaggagaatcgcttgaacctgggaggcggaggttgcggtgagccgagatcgcgccactgcactccagcctcggcgacagagtgagactccgtctcaaaaaaaccaaaaaacaaaaaacagtcaatggcattaaatataaatacatttacagtgttgtgtaaccatcaccactatggatcccccagactttgtcatcatcttcaacctaagcgctccctattaaatagtaactccccacttttcccaggccttggcaaccaccattctaatccctgtctctatgaatttgactcctc

SEQ ID NO: 371013 - DNA, 720 bp, Homo sapiens
gttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacaggtgagtgccaccacatccagctaatttttgtatttttagtagagacagggtttcaccatgttggccaggctggtatcaatctcctgacctcgtgatccatctgtctcggcctcccaaagtgctgggattacaggcgtgagccaccgtgcccggccattgactaaggtcttaaaatagctcttcctgcctgtataatctccattatggcagggctcatataagaagatgacagttcatctgatgaggaagaaaacttactcctagttagattgggttgaattcttccctgtttccagcggtgtctgctcctggcacctcaggcacagtcaggggtaggaggtggtgatcagatacactcgctgtgagcagtgcaaggggaagcaggtgcccagagg

SEQ ID NO: 371014 - DNA, 344 bp, Homo sapiens
atcacaccaacaaccacgtgcgtgagcttgctgtgtgctcttgcttgggagcaagttacaggttcagcccaagaggagcggaccactccagggtgtaaataccaagggggcaccgctcctggctgtaacatgttttcaatatcccccctcttcggtggcacaggggctggccccatatacctgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaataagtta

SEQ ID NO: 371015 - DNA, 2348 bp, Homo sapiens
gttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgcagtcccagccactcgggaggctgaggcaggagaatggtgtgaacccgggaggcggagcttgcagtgagccgaga

SEQ ID NO: 371016 - DNA, 3165 bp, Homo sapiens
atggagttttgcttttattgcccaggatggagtgtaatgatgcgatctcggctcactgcaccctctgcctcctggtttcaagcgattttcccgcctcagcctcctgagtagctgggattacaggtgcatgccaccacgcctggctaattttgtatttttagtaaagacgcggtttctccatgttggccaggctggtctcaaactcctgacctcaggtgatctgcccacctcggcctcccaaagtgctgggattacaggcgtgagccactgtgcccggccaggtctgtgaggttttaaaccacctgtctgtggcactttgttacggaacccgagctgagtggtacagggaggaaggccctgtggttcagcgcattttacagctgaggaaactgaggctgcagtctccatctgtgtgtcctttggttgcttgtatgagtgaggtggcaggtttgggaatgaaaccacgcctgcggtgccggggctcccaccggtaacctcccgtttttggcctcggggctccggcaggaaggagtcccaaggcttagatggaggtgcggagggcgtgtgagtgtcctggagctgctgtaacaatgtactgcaaacccagtggcttacaccctcagacgtgcattccctcacggttccggaagccggcagtctgaatcgcggtgtccctgtggctgtgacctgtgagacgggccataatcctcccagcctcttccacttccagcgggggcggcccaccctcaccttggagctgtgcctctccggtctttgcctctgtccacacatggccttctccccatgtgtctctgtctctgttttcccttcctataaggacaccagtcattggattagggctcaccctaatgaccgcatcctgacatggccacttcggcacagaccctgtttccggcacaggccacattcacaggttgtgggagcacaggagtgtttctgctggtgcatcaggctggggtctgtcctcaccgggatgtctcctcctccacccctctcttccagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371017 - DNA, 2547 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggaagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371018 - DNA, 1925 bp, Homo sapiens
gctgaggattgtctgttcatcccaggtggtctagtctgcctggatcagatgtccttccctgctgctgttgggcaggcagctcagccttttggctccagccagctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371019 - DNA, 2725 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacactgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacatttacatcatcttgagtacagttctctcaaggaaaaagcaagcccagcatcttctgccatggcaaccctggcttggagcctccataagagagaaggccctaagaataccattttcttgctctaagttgctcttacgggaaagaagtgataatattcttcctaaacgccatcattcgtgcatccttcccacctacatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaataccaccacgcccagccgggtttatagttttataacccttatgacaaatctcatagtattctgcagggataagcatgaaaccactcgttcaataagtgcaaacaaaaacgccaacaattcttaagacatttctaatcttattttaccaataattttaaagccagcttatgtattaaagatttataactacttttattaacacgtttaaaattctatgcagcttaaagcatttataatggataaaactgccaatactgagtgcctgacataatatttgaaaggtggcaggcattcaaccatggtcactgaatgagagatgtagggaagatgatggcagggaggtttttagatatcaacaccctgatagttctcattttaaccacctgtaagtgcacatacaagtcaacggcactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaataagtta

SEQ ID NO: 371020 - DNA, 2316 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacactgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacatttacatcatcttgagtacagttctctcaaggaaaaagcaagcccagcatcttctgccatggcaaccctggcttggagcctccataagagagaaggccctaagaataccattttcttgctctaagttgctcttacgggaaagaagtgataatattcttcctaaacgccatcattcgtgcatccttcccacctacatgtgtcaccggatcattctccgcctgggcggggccgtcctgtgcactgcagaatgctgagcagtgtccttggcttcgaccgaccacatgccaggagcaccccaatttctgccatcgggtgattgacttcactgttgcatttgattttttatgtatcttttaaaaggacccaatactgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaataagtta

SEQ ID NO: 371021 - DNA, 1539 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccccacgaggaccccccccccccccccccccccccccccccccgccccccccccccccccccccccccccgcccgcccccccccccccccccccccccccggtggccgtcccttttaataagccattgggacaaaatttgc

SEQ ID NO: 371022 - DNA, 1405 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggtgggatacatttgatatgctgccactatgactgagttagaggctgattttttaactttggtatttacctattagtttcatatcg

SEQ ID NO: 371023 - DNA, 1853 bp, Homo sapiens
cagccaaggggaaagggctagaggagggctctgtgggactccagggacccggagctccctgaccggggagcggggcttccttccttctctctgagcgagtgtggactaaatgccctgtgggctgattgcagggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371024 - DNA, 1338 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccacttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371025 - DNA, 423 bp, Homo sapiens
atttgaaaggtggcaggcattcaaccatggtcactgaatgagagatgtagggaagatgatggcagggaggtttttagatatcaacaccctgatagttctcattttaaccacctgtaagtgcacatacaagtcaacggcactggccgggcgcggtggctcatgcctgtattcccagcactttgggaggccaaatcacaaggtcaggagatcgagaccatcctggctaacacggtgaaaccccatctctactaaaaatacaaaaaatcaactaggcatggtggcacgcacctgtagtcccagctactcaggaggctgaggcaggagaatcgcttgaacctgggaggcggaggttgcggtgagccgagatcgcgccactgcactccagcctcggcgacagagtgagactccgtctcaaaaaaacca

SEQ ID NO: 371026 - DNA, 584 bp, Homo sapiens
gtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtggtgggcgcctgcagtcccagccactcgggaggctgaggcaggagaatggtgtgaacccgggaggcggagcttgcagtgagccgagatcatgccactgccctccagcctgggtgacagagcaagattccgtctca

SEQ ID NO: 371027 - DNA, 512 bp, Homo sapiens
gctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctccgttgacctggcctgccagcctctaacagccccgggaagcaggcagagccctgctggcggatgagaaaaccgtgtctcagaggaagaggccgtgggagctgacgcctggagtcaggctgtactcagggtaactccagcttcaccccaaaccagctgcacctcctggggaagagctgttacccctctgagcctgtttcttcatctgcagagtgcaggccttaataggactcacctcacagtcactgggggggtta

SEQ ID NO: 371028 - DNA, 2742 bp, Homo sapiens
gttgatggtgacagcagcagtgaccgtagcagcctagaggtggccgaatgcttactctaatgggctggcccatccctgagtgtctagagttcccagcccgcttaaggaaggaaggaaaacacaggcagctctaagtgtacgacgagggaggtctcatcggcggtgaggaagcccaggcgggtccccttcccagctgaaaggggttcggaatttcactctgtcgccaggctggaatgcagtagggcaatctcggctcactgcaacctccacctcccgagttcaagtgatgctcctgcttcggcctcctgagtagctgggactacagggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371029 - DNA, 2615 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371030 - DNA, 2898 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctccgttgacctggcctgccagcctctaacagccccgggaagcaggcagagccctgctggcggatgagaaaaccgtgtctcagaggaagaggccgtgggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371031 - DNA, 2168 bp, Homo sapiens
tctgaaagacggtctgtggaccagcggtgccagccccactgggagctggtcagagttacagtatcttaggtcccaccgccacgcaccgatgcaggctcccggggtaagctcagcgttctgggcttatgaagccctccaggaaagctcggctcccagcagccatgtggcagagccgctccgcaagataagaccacttcactaagattccagagcaagagggacgatggggtttgagtgcaggaagcagcctggtgcccggaagccccacagctgggtgtgggctgccacagcctcccaggtgaggctggacccctccctcagtcttctctttctttcttccccaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371032 - DNA, 2274 bp, Homo sapiens
agccgcgcctgcgcctccgctcgcctgtggctgcgtcgcgcgctcttcctcggagctacccaggcggctggtgtgcagcaagctccgcgccgaccccggacgcctgacgcctgacgcctgtccccggcccggcatgagccgctacctgctgccgctgtcggcgctgggcacggtagcaggcgccgccgtgctgctcaaggactatgtcaccggtggggcttgccccagcaaggccaccatccctgggaagacggtcatcgtgacgggcgccaacacaggcatcgggaagcagaccgccttggaactggccaggagaggaggcaacatcatcctggcctgccgagacatggagaagtgtgaggcggcagcaaaggacatccgcggggagaccctcaatcaccatgtcaacgcccggcacctggacttggcttccctcaagtctatccgagagtttgcagcaaagatcattgaagaggaggagcgagtggacattctaatcaacaacgcgggtgtgatgcggtgcccccactggaccaccgaggacggcttcgagatgcagtttggcgttaaccacctgggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggctctggtgtgactgtcaacgccctgcaccccggcgtggccaggacagagctgggcagacacacgggcatccatggctccaccttctccagcaccacactcgggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcagccagcaaaccccaaacaggaacctatggttggtgatggatgtgcgttcagaaagcagggagggagggggagtcagaggtgagggggtcatcagccatagctgtccgctgcatcaccccctcgctatctccaggaagcgttctgggcttttcctgttgtgcagtgtggaagtgctctatcttcattcatatcaaggaaagtcaaaggacaaactaaagccggcagcgtctttctggcttcctagtcaggctgttcggtagcggagtgtcaccctgatttccagccccgcagcacacacactgagagcctgcctggcgtgattcagaggcaacgtatttcccaaggtggctgtgaaggaaccagggggataaacacagcccgtgaaccgcacgccagaggacaggtccggctgcctgccgcggagtcgtcacggcgtgtcgcgtctgagcgcttctccaaagcacccaagtggcacccggggtgacatttacatcatcttgagtacagttctctcaaggaaaaagcaagcccagcatcttctgccatggcaaccctggcttggagcctccataagagagaaggccctaagaataccattttcttgctctaagttgctcttacgggaaagaagtgataatattcttcctaaacgccatcattcgtgcatccttcccacctacatgtgtcaccggatcattctccgcctgggcggggccgtcctgtgcactgcagaatgctgagcagtgtccttggcttcgaccgaccacatgccaggagcaccccaatttctgccatcgggtgattgacttcactctgtgcctggctgatttttattcttttagttaaggctggttgatattaccttgtgtgtatataccacatgttgtttatccattgttgttgatggacatgtgggtggtttcaccttttggctattgtgaataaagctgctatgaacactgtgtacaaataagtta

SEQ ID NO: 371033 - DNA, 2208 bp, Homo sapiens
gctgaggattgtctgttcatcccaggtggtctagtctgcctggatcagatgtccttccctgctgctgttgggcaggcagctcagccttttggctccagccagctctggtgtgactgtcaacgccctgcaccccggcgtggccaggacagagctgggcagacacacgggcatccatggctccaccttctccagcaccacactcggtgagtcccctcccagcctggggtctccacgtggagccctccacccctgctttctcagcccagggcccaggaccctccctcagagaccgtccctgaggcctcatgcctgctcctcgcctacgtcttctgaggcacagagcacaggtccctttcctccgttgacctggcctgccagcctctaacagccccgggaagcaggcagagccctgctggcggatgagaaaaccgtgtctcagaggaagaggccgtgggagctgacgcctggagtcaggctgtactcaggggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371034 - DNA, 2026 bp, Homo sapiens
cttaaagcatttataatggataaaactgccaatactgagtgcctgacataatatttgaaaggtggcaggcattcaaccatgggtcactgaatgagagatgtagggaagatgatggcagggaggtttttagatatcaacaccctgatagttctcattttaaccacgcccggccttatttttatttttgagatgaagtcttgctctgtcgcccaggctggagtacaatggcatgatctccactcactgcaacttccacctcccaggttcaagcgattctcctgtctccaagtagctgggattacagggcccatcttctggctgctggtcaagagccccgagctggccgcccagcccagcacatacctggccgtggcggaggaactggcggatgtttccggaaagtacttcgatggactcaaacagaaggccccggcccccgaggctgaggatgaggaggtggcccggaggctttgggctgaaagtgcccgcctggtgggcttagaggctccctctgtgagggagcagcccctccccagataacctctggagcagatttgaaagccaggatggcgcctccagaccgaggacagctgtccgccatgcccgcagcttcctggcactacctgagccgggagacccaggactggcggccgccatgcccgcagtaggttctagggggcggtgctggccgcagtggactggcctgcaggtgagcactgccctgggctctggctggttccgtctgctctgctgccagcaggggagaggggccatctgatgcttcccctgggaatctaaactgggaatggccgaggaggaaggggctccgtgcacttgcaggccacgtcaggagagccagcggtgcctgtcggggagggttccaaggtgctccgtgaagagcatgggcaagttgtctgacacttggtggattcttgggtccctgtgggaccttgtgcatgcatggtcctctctgagccttggtttcttcagcagtgagatgctcagaataactgctgtctcccatgatggtgtggtacagcgagctgttgtctggctatggcatggctgtgccgggggtgtttgctgagggcttcctgtgccagagcccagccagagagcaggtgcaggtgtcatcctgagttcaggctctgcacggcatggagtgggaaccccaccagctgctgctacaggacctgggattgcctgggactcccaccttcctatcaattctcatggtagtccaaactgcagactctcaaacttgctcatttaaaagaaaaaaaaaagaagaaaatgtacccgagtcgtagattttatttttcctctgtgcatgggtgaatgcccatgagctgaacaaaggcaactcatggctttattccttttaggaaacaaggcatcagtttatcaccagggcaacaggccatgcaaaagttcagacttggccgggcgcggtggatcacgaggtcaggagatcgagaccatcctggctaacacaatgaaaccctgtttctactaaaaaaatacaaaaaattagctgggcatggtgtgctgggattataggtgtgagccagtgcacccagccctttttgcttttttagagacgaggtcttactgtgttgccaaggctggagtgcagtgccgtcacagctcactacaacctcgacctgtgattctcctgcctcagcctcctgagtatctgggactacaggtgcatgccaccacacttggctaattatttgtagaggtggcaacataacatttgctatgttgcccaggctggtctcaaactcctgggctcaagtgacccttccgccatggcctcccaaattgttgggattacaggcatgagccaccgtacctggccttagttttctttccgatgccacaccaaatggctagagggtgtgtttgggatgacctgagtctggtaggcaacttccagtggaccccacagtgcgaccacctccctttgagtgtgggggagatgtagcgactggcttctagcagtaggagtagggcagaagtg

SEQ ID NO: 371035 - DNA, 303 bp, Homo sapiens
cctcccaaagtgctgggattttaggtgtgagtcaaaagtgaccttttcatcatccttaatccaggtcactttctcttgacaaacttgctgctggacaagctgaaagcctcagccccttcgcggatcatcaacctctcgtccctggcccatgttgctgggcacatagactttgacgacttgaactggcagacgaggaagtataacaccaaagccgcctactgccagagcaagctcgccatcgtcctcttcaccaaggagctgagccggcggctgcaaggtacgggggcgctaggctcggcctcc

SEQ ID NO: 371036 - DNA, 355 bp, Homo sapiens
ttatataataatagcttgcaagtctttttaaaaatgtctgatttgtttaaaacctaactatatattttgggcattttctcatgccattaactatcctttggaaacattattttttccaagatacggtttccttttatccttctttttacaaaagaaatgcatcctcattccttaaaacaacaacaaccaaggacaaccagaaggaggatttaaaaaagttactgacaggccaggcgcggaggctcatgcctgtaatcccagcactttgggaggccgaggcgggcagatccctgaggtcaggagttcaagaccagcctggccaacatgctgaaaccctctctttactaaaaataca

SEQ ID NO: 371037 - DNA, 2243 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371038 - DNA, 2213 bp, Homo sapiens
cacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacaggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371039 - DNA, 1801 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtgggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371040 - DNA, 2206 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371041 - DNA, 1400 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggcaagctatcctccaggttcagctgacaaatatgtttgttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttct

SEQ ID NO: 371042 - DNA, 2179 bp, Homo sapiens
gttccggcgcggccagggcccaacttccggcgtccgtcgggcagcagcggggctgtctatcccggctgaggacccgcggccagtgcgggtggctggctttgccattagcgggggcctttcctgaggacggcgtacggagtgtggggaatgaaggatggcagcatgccgtgcattaaaagctgttttggtagatctcagtggcacacttcacattgaagatgcagctgtgccaggcgcacaggaagctcttaaaaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371043 - DNA, 2183 bp, Homo sapiens
taagcttggtctgtaagaacagaattctggagtaaagaagcaggttcccttttcgctagacacctcgtctgctactggaacacatccattgtatcttcagcctccatttccaaatgtgcagggaatgaaggatggcagcatgccgtgcattaaaagctgttttggtagatctcagtggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaagtttactagagcggaaacaagtcagacccatgctgctagttgatgatcgggcactacctgatttcaaaggaatacaaacaagtgatcctaatgctgtggtcatgggattggcaccagaacattttcattatcaaattctgaatcaagcattccggttactcctggatggagcacctctgatagcaatccacaaagccaggtattacaagaggaaagatggcttagccctggggcctggaccatttgtgactgctttagagtatgccacagataccaaagccacagtcgtggggaaaccagagaagacgttctttttggaagcattgcggggcactggctgtgaacctgaggaggctgtcatgataggagatgattgcagggatgatgttggtggggctcaagatgtcggcatgctgggcatcttagtaaagactgggaaatatcgagcatcagatgaagaaaaaattaatccacctccttacttaacttgtgagagtttccctcatgctgtggaccacattctgcagcacctattgtgaagcaatgtgtgcatctgaagcaacttgaaatgcagcttcttattgtctggaatgaatcccttaccaactcagtgccagcatcggtagacaccagtcagtgctgatcgctttttaaccctcttttgttgtgcattaattagaaagaaaggtattgaattgcggctagccagtaagccttgctaatctcttttattttgtaactgaagatgagacccaaagaaagggaaagctgagattttgtgccattccttttaaaatattcatcaggttaggtggggctgtgggggaaaagctactacagggaagagtgttctctgctgtctcttcactggaaaacagggaggggggatttcagactgtgaagaaagttgaatggtggtttttaaattataaagtaatgtattaaaaggtgcattaggctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtga

SEQ ID NO: 371044 - DNA, 593 bp, Homo sapiens
accctgtggacacagagtgacagctgagtgcaagtgtcagtgaagagacctagattgtggggactttcctggcctggcagagaaccttgtgtctgctcacgggagaaggaaagaacaattcctctgcagaactcccattatggattcatgggtatacttggatggtgtctgaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaa

SEQ ID NO: 371045 - DNA, 1540 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371046 - DNA, 755 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacacagactaggaattggcaaggtgatggaagaaacactcagctatctactaggaagg

SEQ ID NO: 371047 - DNA, 592 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacaggtaaggaaaaaagtctttctttgaattcctggaatttagttgaaaattttggacttcaaaatttgtaaggtgttattgtctagttagttcagttttctgatacaatctggccaggaaatgcatattttaaagtcctctcaccattttccaacattgtataattatagtcacatatccacttacttttgtggctcgtgatctcagccaaggctaaattcatttgaacctacagaatgttttctcatattttttaggagaaaatatttttctttgaattgaaatggactctttctgcattgtagctactcattgaggtttagttgctcttgttgtttttgatgttactgtgtgtatgtagaggaagagagaattttaagaaatacatttgtttagtt

SEQ ID NO: 371048 - DNA, 583 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagattcccgatgtgccaggattctcctgggtgactccctgtatatctgccaaggatattgtgtatattggcttgagagacgtggaccctggggaacaacacctacatttgacaaactctaggcattacatactcttcaatgacttgaagtgggcaccacgaccctaaagcggaaacattttggggcgcacacggctcgatggacagaaaccac

SEQ ID NO: 371049 - DNA, 1486 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371050 - DNA, 1467 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371051 - DNA, 1571 bp, Homo sapiens
ccctattaagcccaaaccagaagattatcactgttacattttggtgtctagtttaactggatggattcaagaagtgttcactgagagcccagtatacagccgcaccagtgtgtgatactggtaacatgacgtcaagcaaaagcagacatgggtctaccttcccaagatttacagacctttcaggtttttcctttgcttatacttgtgaatatatgcctattttatacaattgagatcatcctacacagactgatttataatctactttttaatttagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371052 - DNA, 1489 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371053 - DNA, 1483 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371054 - DNA, 1429 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371055 - DNA, 1497 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371056 - DNA, 1604 bp, Homo sapiens
ggacttactgagaaagggaagtaaagaaggaagctaccaaagtaatgggagcacaatcgtttctttatagaggagccctgggaaagaagggcccagcaggactggggcacaaagtaggtaaatgccaactggttcaaggcaaagtcaaagcaatcaaggggaggcacacatcctcttcttaattgtgtattatttttacatgatttcttctgtatttatattctaaatataagatatacgcaatccaatatgtgtctttacctttgaatgtaggatttgttcaagagaatcatacataaccaagtgaaaacattgtaattttagattcccgatgtgccaggattctcctgggtgactccctgtatatctgccaaggatattgtgtatattggcttgagagacgtggaccctggggaacaagtaagcttattccttgatgtgatttgcctccatttttgtccctttgtgtgctagatatgctttactgaccaactctatgagagaaaattaaacatcaagacacacacacacacacatgcccacacacatatatttatatacatgtacatacatatgtatgtatccaggcaattaaatctcaattgacttgctgttaaaaataaatacaaataaaactatattgagttaggttcatagaacctaaatgttttatatattttactatatttatatttcccttaaaaggagacaggcgggcacagtcagccttattaattataattatcttaatttctcttttatagctacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371057 - DNA, 967 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371058 - DNA, 1168 bp, Homo sapiens
  misc_feature (886)..(886): n is a, c, g, or t
  misc_feature (888)..(888): n is a, c, g, or t
  misc_feature (910)..(910): n is a, c, g, or t
  misc_feature (1026)..(1026): n is a, c, g, or t
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacacacacacactttntntctctctctctctctctccagnggctggtaagttctgaaggactggggactgctagacataattgaaagtaaggtaacaggctaaggagaagctcagtttgaacattgcaatggtaaagtcctcaaagccttggactnttcaagtattttctggtggcattaattggattttcctgcttagctgggttcagacataggatttgcatttcttggagctttcatccaacaggctacatttttagtctggaagagtctaataagccttatttgacatctgagg

SEQ ID NO: 371059 - DNA, 913 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371060 - DNA, 894 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371061 - DNA, 799 bp, Homo sapiens
ctgaagtactttattttttaattgttcagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371062 - DNA, 1097 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacaactaacatttttgaaaactctagggcctttaaattacttttcaaatgacctgacagttggaccagactcaggacttgggccagggtgactgggcagaaaacactccaggtaatcttaccttaagggaacgaacacggaagaaaggcccaatttcactgctaaagggttttcggaatggctttgacccggcacctgtggaagccccacttctgtttccaaacagccccagcgtacgttgtggccaccacccacaggtgtcgtggcggaaaaggcgtcttgacaccattacacacgtacgccataggctcctccttcgcctatcaccagcgcatcgcgaaatttctttcgacaccaacacccgcgcggtacctccccccatcgggacgaccgaacttct

SEQ ID NO: 371063 - DNA, 913 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagtcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371064 - DNA, 497 bp, Homo sapiens
gagtagtccttctatatcatagaggcttttcaaaaaagaaattttaaaatttcagatataatggtttatgaactaatgtatttactgggagaagcacctatctaaatcataagagaaagaactatctccctgctccctagaaactccttttctaaaagatggaaaataaaatggcagattaagatttaatattacagcttataactttgttgatatgccatagtttgttgatatgccatagtatatcaataaaaagtttttattgatacaattataatatttggtccttatgatgatacaagaggttaaaacctccttatgttaaatgctcagaaataatgtcttttgaactaatgaccaagggatgggtttataaacttgcaaagtatctgcctagtacatgggaaaaactaaacgtcctggaggacaaagcagatatcatcatattatcacattaagaataaccaaaggacaggccacaaatttccctcagctgc

SEQ ID NO: 371065 - DNA, 643 bp, Homo sapiens
cactcagctatctactaggaagggtaggattcttttgtgtgtgcacacatgtgtgtgcaacagaaaaggttgctactgacaaccaaagttattaataaagtctttacatgaaataatgggttgctactttttataaaacaagttaacagattattatctatgaaatgtgaagccatcaaccttaaactgaaatcctttcccacttcttaaaagaaagaaaaggccaattcatctaagttttgatgttgacggactggacccatctttcacaccagctactggcacaccagtcgtgggaggtctgacatacagagaaggtctctacatcacagaagaaatctacaaaacaggtagttaacaatctgaggtaatagagaagcaagtgtacacttgactaatatatatttatacctccttgacctgaaaccaagtcccagctgacactttcagaatgtccatcagtcacatgatgcaataactaaagtgttttccatcggttactacctttttctgttagtggataatctttcaagtctgtctgtactactttcaaaatgtcaactattttataaattacattattacaatttgttgttgtagggctactctcaggattagatataatggaagtgaacccatccct

SEQ ID NO: 371066 - DNA, 1286 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggataactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371067 - DNA, 449 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcaagcccattttttggcattgcaaggtgccaccttgaccttgaagcttcgggtggg

SEQ ID NO: 371068 - DNA, 1395 bp, Homo sapiens
  misc_feature (48)..(48): n is a, c, g, or t
gtgcttatacaacccatatttttcgtccaaggcacggccctagcgcgnaccaccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371069 - DNA, 1386 bp, Homo sapiens
tcttactctgttgtccaggctagagtacagtggcacgatcatggctcactacagccttaacctcccaagttcaggtgatcctcttgcctcagcctcccgagtagctgggactacagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371070 - DNA, 1443 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371071 - DNA, 1831 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacaagtaagcttattccttgatgtgatttgcctccatttttgtccctttgtgtgctagatatgctttactgaccaactctatgagagaaaattaaacatcaagacacacacacacacacatgcccacacacatatatttatatacatgtacatacatatgtatgtatccaggcaattaaatctcaattgacttgctgttaaaaataaatacaaataaaactatattgagttaggttcatagaacctaaatgttttatatattttactatatttatatttcccttaaaaggagacaggcgggcacagtcagccttattaattataattatcttaatttctcttttatagctacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371072 - DNA, 1181 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagtgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371073 - DNA, 1371 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaagatgtggaaattctaacttttttgaaatttaaaagcttatattttctaacttggcaaaagacttatccttagaaagagaagtgtacattgatttccaattaaaaatttgctggcattaaaaataagcacacttacataagcccccatacatagagtgggactcttggaatcaggagacaaagctaccacatgtggaaaggtactatgtgtccatgtcattcaaaaaatgtgattttttataataaactctttataacaagaaaatattgtg

SEQ ID NO: 371074 - DNA, 1148 bp, Homo sapiens
  misc_feature (1092)..(1092): n is a, c, g, or t
  misc_feature (1139)..(1139): n is a, c, g, or t
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatgctantagaagtatcattctaagctaagatctctaagactgctcagaatgtntcatagtaa

SEQ ID NO: 371075 - DNA, 1411 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagggtaaaagactggttggtactctagtgcaatagaatactttttagtagacattcaggaggtggaagggaaatgagaaactccatgttatcttattcttggtgtaatctcaaatcattttctctgcagccaataagcaaagggttggttgataaaaggcagtgaggctctctatctctgccttgcaaactgacttaatatatattttctctgctaattcttaaactatccttttagtaggtggggcagagagtaatcatttataaacaggtcagtggaggttcagaggttaaccaacttgcccaagatatatgccaagcctatagtgaagcaagggctagcaccaggtctcctcattccttcctctttccactacatgccacacagttctgcattcttactgagtagtccttctatatcatagaggcttttcaaaaaagaaattttaaaatttcagatataatggtttatgaactaatgtatttactgggagaagcacctatctaaatcataagagaaagaactatctccctgctccctagaaactccttttctaaaagatggaaaataaaatggcagattaagatttaatattacagcttataactttgttgatatgccatagtttgttgatatgccatagtatatcaataaaaagtttttattgatacaattataatatttggtccttatgatgatacaagaggttaggatgggtttataaacttgcaaagtatctgcctagtacatgggaaaaactaaacgtcctggaggacaaagcagatatcatcatattatcacattaagaataaccaaaggacaggccacaaatttccctcagctgctctaggccatcctctgg

SEQ ID NO: 371076 - DNA, 911 bp, Homo sapiens
tagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttcttacaatatctgtattttgacctagtacagcagaaaatgtatgaaatatgaatggatttcatctaaatattcatcacaagcttacatttctaaataagtatgtgaggcaattcatagcttatttgttcttaattgccgataatatatacaactcatataggtcaacaatttcaaagcatgtgtttttcattataaaagtaatgatcataacatttttgaaagcatcagacacacacacacaagaaaaaaaatgtggtaattgtacttctctagcaaccatttcaaccagaattgaaaatctggcacatttctttcatggcatcttttttttcctt

SEQ ID NO: 371077 - DNA, 118 bp, Homo sapiens
gctggatgcaataaaagcaatgcttcaaaggaaatatattgccttaaatcatttaatgttgaggctttctcctttgagtttcaattctaatattagagaaagttcaacatagaaatcc

SEQ ID NO: 371078 - DNA, 379 bp, Homo sapiens
tctgagaagtgaggagaccctccgcctggcaaccgccccgtctgagaaactttccccttctcttgaggtggtgcctgggtatacagggatgttgaaggggtccacatggcatcatgagagtggagtgaagcaggacatagtaaagaatttaaccttgctcaaagagagacatggcttttgtccttggcccctggaaggtaatctctaagcccttggaatgcttgcctggtaagagtgcctttgtttacctgggggcattggtccataacagatagtctaacaaggggagccacggcagggcttttgttcacatcatatcagcttaatctctgaagatgctgaagactgagcccagccacatgggcagccaaccagattg

SEQ ID NO: 371079 - DNA, 647 bp, Homo sapiens
agtgaatctgttaaatccaaacagttttcaccatccggttatctttcagatacagaggaaagtaatatgatttgtcaaacaatgaaatgtcagcgttatcaaactccatacctgtcagaagaaaccacgtatttggagccaggaaagatcagtgtgaattgtggacacccatctcgtcataaggctgatagattaaagtcagatttcaaaaaactgagcagtacattaccatcttcagtgtgtcagcagccttcaagaaaattaattgttccgctatctagccaacaagatagtggctttgatagcccatttgttaatctagactaattatggtacagtatttaagaagaatcattaatatattaacaaaaatggaagggaagacctcatactgaaaaaaattgtgagccctgcctcttttgagatgttttaataacatctgttatataagtaaagcattcttctaaaattgcttgagatatttatgttgccttaatattccaaaggcctgatggtgtatgtataatctgcttttgtgtggtgcttatttttggtttctaaaccatctatttttatacttataaattgactcactctgcagtgttaacttatttaaataaacttgcatatggtctgtaaaaaaaaaa

SEQ ID NO: 371080 - DNA, 9492 bp, Homo sapiens
gttccactcacagatttcttcttattgcccaggcttgagtgcaatgacctgttctcagcttactcaacctctgcctcttgggtttcagtgatttttctgcctcggcctcctgagtagctaagggaggagtcttgagattatcatccacggagggtggaagaggagagggtggaaggggaataagaagacattcgggaggtgtcttgaggctcagggagttatcagttatagaatgttgttgagttggaggaagtggctggcggcccatcctgttttttaaagtttcacctgtgaagtagggccagtagggcaatcctgaagaatgacgatgctccgctgccgccattctgacctgtaaggccgaaagaaagggaatgttttcacacatattcatttgatggacaaaattaccgccaccaacacggtctgcaccttctgttgctggtgataaatttttgcacctttccatcctccaggtttcaaaatagcagtatcagtgtcataatatcacccttccactgagtactgccgacagctggggagtaaaaaaaagtcattgggacatcaccctacagcagttcaggctgtgtggttcgcaagaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggagaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaaaagtgtgaagtaagacaaaatggacctctaccaagttgtagggaaggacaaggaaaaga

SEQ ID NO: 371081 - DNA, 806 bp, Homo sapiens
tgcggctccggtgctgtgctgcgggtgttcagatccggacaagtgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccctgcgttctggggacaaccatcctccctcagagtgcttctcagccatgattgactggtgtgcaacctgtctcagtgggttcttccgctggtggtgccctaagggggactggaagccattcag

SEQ ID NO: 371082 - DNA, 350 bp, Homo sapiens
ctagtcagtgctattactttgagtttgttttggtaaagttgcttgcctacatatctgtaactgaccttttctttctttctctgccaggtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggccactgacaacgcctgggatcctctagacct

SEQ ID NO: 371083 - DNA, 8502 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371084 - DNA, 9255 bp, Homo sapiens
gttccactcacagatttcttcttattgcccaggcttgagtgcaatgacctgttctcagcttactcaacctctgcctcttgggtttcagtgatttttctgcctcggcctcctgagtagctaagggaggagtcttgagattatcatccacggagggtggaagaggagagggtggaaggggaataagaagacattcgggaggtgtcttgaggctcagggagttatcagttatagaatgttgttgagttggaggaagtggctggcggcccatcctgttttttaaagtttcacctgtgaagtagggccagtagggcaatcctgaagaatgacgatgctccgctgccgccattctgacctgtaaggccgaaagaaagggaatgttttcacacatattcatttgatggacaaaattaccgccaccaacacggtctgcaccttctgttgctggtgataaatttttgcacctttccatcctccaggtttcaaaatagcagtatcagtgtcataatatcacccttccactgagtactgccgacagctggggagtaaaaaaaagtcattgggacatcaccctacagcagttcaggctgtgtggttcgcaagaagcatacactggctttttgattcttgctagttcccagctcacagtttgggaggatccaacaccaacctttacgtgaagtggaggcccaaggacagtgaggagctgggtggtcccagcctggagctgtgccagcctgacatggaaatggagaatctttcctttccggtgaccagggccctgcagatgtcgccaggaaagtggtgatccaggcaggaccaggctgcactgaagggacagaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371085 - DNA, 8412 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatcttctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371086 - DNA, 8150 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371087 - DNA, 7400 bp, Homo sapiens
gaagtcgagcctgtacccacgatatcggtcatgaagtcaccctagccatcttctactatcaacattactaataagtggctcctttaacctctccacctgtcctaggggagtctgtcctgcaggataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371088 - DNA, 6592 bp, Homo sapiens
attttatcttctccttcttttccctctgactttttccttcagtttcctgcttgtctttcctttttctttctcagccttggatttcttcttagcttccttctgctttaagctcgtggtctcttgtttccgcttatttctggcctgcccttggatagtagtctgacactctctccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371089 - DNA, 8355 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371090 - DNA, 4708 bp, Homo sapiens
tgcatcaacgcgttgggagcttaccatatggtcgactgcaggcggcgcgaattcactagtgattgagccagctcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371091 - DNA, 2942 bp, Homo sapiens
atgtgggtgaaccccccggtctttgctactgctgcaactcctacccagctcacagttttgcccctgccctgtccaggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371092 - DNA, 3573 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagggctgagaaagaaaaaggaaagacaaagcaggaaaaactgaaggaaaaagtcaagaggg

SEQ ID NO: 371093 - DNA, 3053 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcaggtgagtgcaagtccctcccaaagtaaccaggacaagtaaaggagatgtaactacttagtgtttctcttttccttatatttttccatttctttttcttcctgactcctctccttattttatttttctttattttttccttttcttttgtggtcttctttcgtattctgtcttaacccccatagttctcttctgatgtattttcctcttgcacattc

SEQ ID NO: 371094 - DNA, 1408 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagaggacacgacgtatagagccctgatagtaatgcgtagtgagcgctgcacaggcacatgataagtcgaagcactcaagcgtcagactgcccaaccatcctgaatcctgccatgctctcagactcggtcatgctcgtgattcaaggaacagtccggcagatcctgcagatctgctttccatttct

SEQ ID NO: 371095 - DNA, 298 bp, Homo sapiens
cggcagaggcagcagatgatcttggaggaaatgaagaagccgacagaggatatgtgtctgactgaccaccaggtagtgaggagagagtaacagttcctgggtcagctgggaagactttcctttaaaaaaaaaaaaaggacttctgcaatgggagagacatttccattaaagattaaaggaaggccgggtgccatggctcacactgtaatcccagcactttgggaggccgaggcgggcagatcgcttgagcccagcagttcaagaccagcctgggcaacatggcgagacctcatctcta

SEQ ID NO: 371096 - DNA, 331 bp, Homo sapiens
atctgggttctaggctggaactcctttttcagctgcagcccctttacccttgagcctcctttccctttttttgtgctgccacttcatcctattccctattcccctgcagtgagattgacaagactctggagagtatgtccagctacaggaaaaacaagtggattgttgaaggccggctccggaggtagggaccagacagagagtagagcctcagagaggagagaagtggggcgggtgaagcatagccagggttttggcttgaaatgtgatgctttagccccttccctgggtttgggaccttaccagggcccaggatggtttagagtcaagg

SEQ ID NO: 371097 - DNA, 300 bp, Homo sapiens
ccggcttatgcatgatagtattttgaagccttaaatcatatttaggcagagattgtagtagggcaagcagtgcatctccagctgttgctaatctcacctgtttcctatactaacaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggc

SEQ ID NO: 371098 - DNA, 682 bp, Homo sapiens
gatgcatcattcctagttgctatagtggttactagggcaaagcttggatggagatagaggaggagtgggatgaggcgaccaagagcttggttcgggcacatattaaatttgacacccccctggagcatgccagttagggctgataggcatttagaaattagatttagagctcagaagaatcactgtagtatagtacattgtagtaaatgtgcaagaggaagtcctggtggtggataacatcacccagggaaataggcttgcagcttgggaagcttggctagggagaaatggacaaaggaggaggagctggtaaaacagtcatgaaagacagcctcaagacagtgttgtcccagacaggaggttctgtactgtctgttgggccaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggatttgtccgcattgtggcagccagcatgtgggtacgagctcgattcgtatctgtctg

SEQ ID NO: 371099 - DNA, 8463 bp, Homo sapiens
agcacgcaaaccagccggtaaatcagataagaccctggccgcacagaggcgcttggaggaacggcagaggagcagatgatcttggaggaaatgaagaacgccgacagaggatatgtgtctgactgaccaccagctcctgcctgacttctcacgagtccctggtctgacattgcccagcaggggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371100 - DNA, 8610 bp, Homo sapiens
cggaatacacagcgcaactagggtgactttgtcttcggcgagctcgatcctaagcccatacctagacctggcagatacccctaggaagaaaaatggagctcgggggggatagtggctttttgaggtgagaaaaacttgtctttccagctctctgcagtggaggctgatttgcatgttggtgattagcaattagcagagccaagtcgctgtgtttttgtggcagcagcaccagctcgcgagtgggagtgcaaattatttcaagctcatgcagagcttctggcctggagagggcaggtgggcgagcccgaaacagccccaacagacaccctgcatcaagaaaggcttctttcaaaatatacggagtggttagggtctagcagcgggcattgaggctgttttaactgactgtggcaggatcagactggctgttaaagtcgtctgagcccaatgtagtgattggcatgcgaaggagggaaggaagcaggcagagcatatcattatttgtctactcagtttccttttttttgttgtttagcattagtacacgtgacagcccctctcatcttttccctcaaaatagataaaagcttagcttccagttgattcctggtacaagggtaaccaccactctgtaaaattacaggatgttttctcgtttcccaatggatggaggagatatctgagaacatgatagagatgttgtatcagaccccactctcttttcctctctttgcctgctgtaggattgattttaccagcacatctctgctcagagtatcttgatgtgatcggttcccagcaatgaactggccgcaataaatgttgaatgaatgaacatccttctagcaaagattgactgcctagtatagctaagtgaaccaatataaggcactgattttgacttttggtctctcctgtgatttcctagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371101 - DNA, 8567 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagagattcaaaagactctgtgtattcatcttcccttctacacacctgagggggagacggcgttgggataggtatgactggcttaagagaccacaggcaagggaacaacaggggctcctgttccataccctctgtgtggatggaaagggtcattagtgctcctgcctaaatgtctggctgagttgctggagcaaagggggattcagtgcatccaggtcctgccttgtgagatgtggccccagcttcctaagctgccacctctgtgttcctgtcatagcaaatatgggaccatcaccagcttaccacttcccactcacggataagacaccaagacgtagacttttgtgttttatttaaaaaaaaaaagtgtgaagtaagacaaaatggacctctaccaagttgtagggaaggacaaggaaaaga

SEQ ID NO: 371102 - DNA, 7343 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacgctgtaaactgccctgacgctgtaaactgccctgacgctgtaaactgccctgacgctgtaaactgacgctgtaaactg

SEQ ID NO: 371103 - DNA, 5580 bp, Homo sapiens
caagtagctgggattacaggcccatgccaccacacctggctgatttttgtatttttagtagagacagggtttcaccatgttggccaggctggtctcgaactcctgacctcaggtgatccgcctgtcttggcctcccaaagtgctggaattacaggtgtgagccaccacacttggccttcccttaatctttctccatctatttcaaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371104 - DNA, 5083 bp, Homo sapiens
agagactacgatggatgctgcgttacagatcgcggccgagtgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatatcatatgagatcacccctcgcattcgtgtctggcgccagaccctcgagcggtgccggagcgcagcccaggtgtgcttgtgcctgggccagctggagaggtccattgcctgggagaagtctgtcaacaaagtgacatgtctagtctgccggaagggtgacaatgatgagtttcttctgctttgtgatgggtgtgaccgtggctgccacatttactgccatcgtcccaagatggaggctgtcccagaaggagattggttctgtactgtctgtttggctcagcaggtggagggagaattcactcagaagcctggtttcccaaagcgtggccagaagcggaaaagtggttattcgctgaacttctcagagggtgatggccgccgacgccgggtactgttgaggggccgagaaagcccagcagcagggcctcggtactcggaagaagggctctccccctccaagcggcggcgactctctatgcggaaccaccacagtgatctcacattttgcgagattatcctgatggagatggagtcccatgatgcagcctggcctttcctagagcctgtgaacccacgtttggtgagtgggtaccggcgcatcatcaaaaatcctatggatttttccaccatgcgggagcggctgctcaggggagggtacaccagctcagaggagtttgcggctgatgccctcctggtatttgacaactgccagactttcaacgaggatgactctgaagtaggcaaggctgggcacatcatgcgccgcttcttcgagagccgctgggaggagttttatcagggaaaacaggccaatctgtgaggcaagggaggtggggagtcaccttgtggcatctccccccaccttccaaacaaaaacctgccattttcacctgctgatgctgccctgggtccagactcaagtcagatacaaccctgatttttgaccttgcccttggcagtgccccacatcctcttattcctacatccctttctcccttccctcctcttgctcctcaagtaagaggtgcagagatgaggtccttctggactaaaagccaaaaaaagaaagaaaaaaataatttttcttttctgttttatttgctaattaaaaatggggagggggaaagtcgtccctacttcctcctccctgcttcctctcctcccctgtacgtgccccagcattctggggttatttaacaatagcaatagttctagtgaatgtgtgaaaccaagaaacactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgtgtgtgtgtgcgtgctgtgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaagcagagagctgaggcatccaagaaatgttccattggggggtgggggtgccaggtgaggtggagcattccttgtattctggcagcactgaagagccactgaagggggtaggggcagtgtaggtcctggggcagcccctttattcctttatgccccttctccctcatagcctatttctaaagtcgccttttctgtcagataaacctcaaaacttttaattttatttgagatttttttttgcttttaagaggtggattgaagaatatttgaattgactttatattatgcataaatatttatattttatctaaataactgcgctgtaacaaactttgtgttagacagttgaaactgttagagttgggggctctgctttttccccctggcaattttcccctggtataagatgtgctagattaatttcattgtgaggtggatgggggagtgaaattgtgaggtggatgggggagtgaaatctccatggttcctgctttgtgttcctctcccagctccatctctttccctagggaccaggcactcatatggcggggtggggtcctagcctcagtttgaagaagtgggggctggagcggggttgggggtggtagggatagggcatgatcaaaggggccatttcttgcttttctttcctcatcttcactgcccccttgagctaggtggattttctcttcatgacaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaaaaagtctagcgaaaaaactcctgtttttgccatgtgatgttccacaagtgcagctgtagaaaagtgcttgtcagttgttgaataaaaaaaccacatttgatagaga

SEQ ID NO: 371105 - DNA, 5003 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttagttcctgaggaggtgataaagaaggaaactgactccttaaaagtggcagcccatgcgtcactcaaccctgccctcttctctatgaagatggagttagctggctccaacaccactgccagttctcctgcccgggcccgaggccgacctcgaaaaactaagcccgggtctatgcaacctaggcatcttaagtcccctgtcaggggtcaggattcagaacagccccaggcccagcttcagcctgaggctcagcttcatgctcctgcccagccccagcctcagcttcagcttcagcttcagtcccataaggggttcctggagcaagaaggctcccctttgtcactgggtcagagccagcatgacctcagccagtcagccttcctgtcttggctgagccagactcagagccatagctccctgttgagcagctcagtcctcacacctgatagcagtccgggaaaactagacccagctccatcacaacccccggaggagccagagcctgatgaggcagaatccagccctgatcctcaagcactctggtttaacatctcagcccagatgccctgcaatgctgcccccacaccgccccctgcagtttctgaggaccaacccactccctcccctcagcagcttgcctcctccaagccaatgaatagacctagtgctgccaacccttgttctccagtgcagttctcttccacgcccttggctgggttggcccctaagaggcgagcaggagaccctggagaaatgccacagagtcccacagggctgggacagcccaaacggagagggagacctcccagtaagttcttcaaacagatggaacagcgttacctaacccagctgacagcccagcctgtcccacctgagatgtgctcaggctggtggtggatacgagatcctgagatgttggatgccatgctcaaggccctacacccccgaggtatccgggagaaggcacttcacaaacaccttaacaagcacagggacttcttgcaggaagtctgcctgcggccctcagctgaccccatctttgagcccaggcaactacctgcctttcaagaagggattatgagctggtcccccaaagagaagacatacgagacagacctagcagtgcttcaatgggtagaggagctggagcagcgggttatcatgtctgatctgcagattcggggctggacatgtcctagcccagactctacccgtgaagacttggcctactgtgagcacctctccgactcccaggaggatatcacctggcgaggtcggggcagggagggactggcacctcagcgtaaaactaccaaccctttggacctggctgtgatgcggctggctgccctggaacagaatgtagaacggcggtacctgcgggagcccctctggccaactcatgaggttgtgctggagaaggccctgcttagcacacctaatggtgcccctgagggcaccactacagagatgtgagtgactcccaccctcca

SEQ ID NO: 371106 - DNA, 3519 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtggcggagagaggtgcgcatcaagaagggcagccaccgatggcagggggagacctggtattatggcccctgtgggaagaggatgaagcaatttccagaagtgatcaagtacctgagccgcaacgtggtacacagtgtccgccgagagcacttcagcttcagtccccgtatgcctgttggagatttctttgaagaaagagacacgccagagggcttgcagtgggtgcagctctcagcagaggagatcccgtcgaggattcaggcaattactggcaaacggggtcgacctcgaaacactgagaaggctaagactaaggaagtccccaaggtgaaacggggtcgaggtcggccacctaaggtcaaaatcactgagctattgaacaagacagacaaccgccccctaaagaaactggaggcccaagaaacattgaatgaggaggataaagcaaagattgctaaaagcaagaagaagatgaggcagaaggttcaacggggagagtgtcagactactatccaagggcaggccagaaataagcggaaacaagagaccaagagcttaaagcagaaggaagctaagaagaaatccaaggctgagaaagaaaaaggaaagacaaagcaggaaaaactgaaggaaaaagtcaagagggaaaagaaggagaaggtaaaaatgaaggaaaaggaggaggtgaccaaagccaagccagcctgtaaagcagataagaccctggccacacagaggcgcttggaggaacggcagaggcagcagatgatcttggaggaaatgaagaagccgacagaggatatgtgtctgactgaccaccagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagcagaaggctgctgtcctggccttccttgtgcatgagctcaatggctccaccctcatcatcaatgagattgacaagactctggagagtatgtccagctacaggaaaaacaagtggattgttgaaggccggctccggaggctgaaaactgttctggccaagcgaactgggcggtctgaagtagagatggaagggccagaggaatgcctgggacggaggcgcagttctcggatcatggaggagaccagtggcatggaagaagaggaagaagaggagtctatagcagctgtccctggccgcaggggtcgaagagatggagaggttgatgccacagcatctagcatcccagagctagagcgccagatagaaaaactcagcaaggtattgtgcttctaacctcccaagagttggagatatgggctgggcaagaattgatcagcttcttttttaaactgaattttaatttttattcttttgagatggggtttcttgcactccagcctgggccacagagtgagaccctgtctcaaa

SEQ ID NO: 371107 - DNA, 2038 bp, Homo sapiens
gttctggcgcccggagcgcggccatgtgaaccgcttgtaccccggggagagacgagccccgagcccggctggacgccgctgcctcaggaaatggaggcaaacgaccattttaactttactggccttccccctgcacctgctgcctcaggactgaaaccctctccttcctcaggggagggcctctacactaacgggtctcccatgaacttcccccagcaagggaaaagtttgaatggggatgtgaatgttaatggcttatctactgtatctcacactactacttcagggattttgaactctgctccccactcctccagcacctcacacctccatcaccccagcgtggcctacgactgtctctggaactactcacagtacccatctgccaatcctggcagcaacctcaaggacccaccccttctctcccagttctcggggggacaatacccactcaacggcatccttgggggcagccggcaaccttcatccccaagtcataacactaaccttcgggctgggagccaagagttctgggccaacggtacccagagtcccatggggcttaactttgattcacaagaactgtatgattcctttcctgaccagaattttgaggtgatgcccaatggaccccctagttttttcacctccccacagacttctcctatgttgggatctagcattcaaacctttgcaccctcccaggaggtaggcagtggtatccatcctgatgaggcagcagaaaaggagatgacttcagttgtggcagagaatggcactggcttggtaggcagcttggagctggaagaagagcagccagaactgaagatgtgtggctacaatggctctgtcccttctgtggaatcgttacaccaagaggtctcagtcctggtccctgaccccacagtgagctgtttagatgatccttcacatcttcctgatcaactggaagacactccaatcctcagtgaagactctctggagcccttcaactctctggcaccagagccagtgagtggaggactatatggtattgatgacacggagctgatgggtgcagaggacaagctgcctcttgaggacagccctgtgatttctgcccttgattgcccttccctcaataatgctactgccttcagtctcctggcagatgatagtcaaacatcaacctctatctttgccagtcccacctctccacctgtcctaggggagtctgtcctgcaagataacagctttgacctgaataatggtagtgacgctgaacaggaagaaatggaaactcaatcttcagacttcccaccatccctgacccagccagctcctgatcagtcatccactattcagctacatccagcaacctcaccagcagtctcgccaacaacctccccagcagtctccctagtggtttctccagcagcctccccagaaatctctccagaagtttgtcccgcagcttctacagttgtctctccagcagtcttctcagtggtctctccagcttcctcagcagtcctcccagcagtctccttagaagtcccgttgacggcttcagtgacatccccaaaagcctctcccgtaacttccccagcagctgcctttccaacagcctccccagcaaataaggatgtcagcagctttctagaaaccactgctgacgtggaagagatcactggagaaggactcactgcttctggtagtggtgatgtcatgaggagacgtattgctaccccagaagaagttcgtcttcccctccaacatgggtaaatgctctagtttgctacatttattgaccttgacaagtttaatgcacaactctagaaagaagggaatgcctcttttcctctgaggtgggggaggaatgggccagacaagagtagattacaggacagttatctgcagtgataatgtttcttggcatgagattcctaggttttccttcttctctcaaggtctgtcttccatcacctattcttttttcatcttgtagtgactcaattttgcccaaggagctccagctattatcttttccaaaccctag

SEQ ID NO: 371108 - DNA, 317 bp, Homo sapiens
caaacttaatcaccttctgaattaggcccagatggcatcacttttatagagggactgagagccattgcctttctctgatatactggatgaattcaccactgtcactctggaaatgtgtttattcatcttcattttcattgtctacccagcgtcagcttttctttcgcaaaaagctgcttcactcatcccagatgcttcgggcggtctccctgggtcaggaccgctacagacgtcgctactgggtattgccgtatttggctggtatctttgtagaaggaacagaggggaacttaggtaggtgtgcctgtgggagtgtg

SEQ ID NO: 371109 - DNA, 1617 bp, Homo sapiens
  misc_feature (1614)..(1616): n is a, c, g, or t
gcagggacccacagtactggggtttaaccagtattcctgttgcttagaggcactcaatcttgatggaagcattatttgcattatcggttactccaaaaccactactggcccccaaagttggtattgtctctgtttgttaggagcttgttgttgttgttccctgccacattgatgaggtggatacatattcagaaggtgatgctttaaaaacacgaggaaatggaaaatcctgcattgatgccttcatttaagggggtgcaggtaatgtgttgatgaagcgtgtgagctttggaatcagatgacctggttttgaatcctgatttccaggctttgagttgtgtgacactggtccttgttttaacctcgttaagcctaagttttacatctggaaaatgggattatactgcttcttgtggttgttgtgaaaattaaaagagttaatgcatatataacagcaggctggcaaatcacaggcactcaataaatattgaccactataatcattcctccttgaatgaaagtggttccaagaaacagagccaaaagagacaactcagagtactaggtttggagagtcttagcatcacctactacctctgtttcctcgaggaaagttaaggactgagcttgtgaggtgaaacaactagcctagctgacagtcaggctctccctcccctcttgctccttcaccattctgtcaaccttttacagcacacaccacttactagctatcatacttttaaaaattgctcgcttatttatctgtctccaacactacagcataagctccatttagctcaggaactctgcccttgttgtcctctcctgtattccccacactgaggataagtgattgaactgaatagttaccctgtgttacttaacattgaatgaatgaatgagttcaatgaggtgcttgttgagagagagacacatacacacacagacacctgtcaccagatcaaccctgccatttaagtattgttatatttataatccaggacgtctgaattcctgcctcctttttaagactctttagagggagatttaacacatgcaggtagctgacttgtgtaaggttttatgccctgtttagccagtgccatgccttttgcagtgcattttatttcattctcgtggagaacagagactgctttttgccatcttggcacagggggtcatgtgtggttgtcattagtcagttcccctagggatctcatgagaacagatcatatgaagcaatcacgttaaatatcatatttcttatctatcctcatcagtcttggtcccccaggttaccactagcaaagaaaagaggaaaacagtaagctgtaacacatagagatggctttgggttagaaagacttccactcttagctagtctttcttgggcaagttgcacagtctcatagggtctcagttcccttagctgggtaagtcgtacctacttggcatggcagaagtgagctctgtttacagtgtgggtaatgtgtatattacacagctagcctcctggcaaatctctgtgggtatgatgtcctcattaaaaaatgaaatgggcgggtgtgtatgtgtcagtgaaaacattaccaactggaggtacagtgttgagtnnnc

SEQ ID NO: 371110 - DNA, 590 bp, Homo sapiens
cccaatacagagtgagagatgatgtgctcttctcagggtgtcacatcaggaggcacactatatccatctgccctcaacggggatgttaattttgatgacctagtcagagtagtgcccagtttctctactgtgtggttatcagtttttctcttgccactaataaggaaacaatttaatgtaaatatactagattacagctttttaaatgacttgaactaaacatatttttgtgattgtactgtgcacagtcatactataaaagccctaaagttgcccagactttcctatctacttttctttatccctgaaatgctctctttcctctcggccacctcgctctgaaactgcctttgttcttaagggccacgtgacaacatccacccagtctttttgcttcctgacttttctcagtctgagcctgacttctggaatcagactgaacatgttgggtgtgttctctgcagagagctctgctgaggtaattacaggttctggaaaccatagtgacctgaactttactgagggaggtaacctatttggagataaagtccaaatatggtcaagaatgaaagcaaaagtttgaagccaga

SEQ ID NO: 371111 - DNA, 7071 bp, Homo sapiens
cagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371112 - DNA, 6780 bp, Homo sapiens
atgggattgtctttttccctttttccccttaggaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371113 - DNA, 7318 bp, Homo sapiens
cagcagctcggtggccgagtcggtcccgcggccggcggatcgggcgcgcgcgtcgggggtcgtccggctgccaggcagggcgagcacgcgccggggtgcgcaagggggaccgcatcctggaggtgtgagtatcggggctacccgccgccccatcctccccgcgcctccatgcccctgcatgtccttcgctacccttgtcatcccccatagccgtagcgtcccctcgatgctcctgacgtccggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371114 - DNA, 7264 bp, Homo sapiens
cagcagctcggtggccgagtcggtcccgcggccggcggatcgggcgcgcgcgtcgggggtcgtccggctgccaggcagggcgagcacgcgccggggtgcgcaagggggaccgcatcctggaggtgtgagtatcggggctacccgccgccccatcctccccgcgcctccatgcccctgcatgtccttcgctacccttgtcatcccccatagccgtagcgtcccctcgatgctcctgacgtccggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371115 - DNA, 7590 bp, Homo sapiens
cagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacaaaaaaaaaaaaaaaaaaaaaaaaaaaaaaaaaaaaaaaaaaaaaaaaaaaaaaaaaaaaaaaaggagggagaagcaaaacaaaaaatatgccgacgaaaggagggacaaccaaatagatagaggagcaacacggtatcttattataacaaaaagaagggacccaagaagagggaagcagtaatataatacacaacagtcagcaggcgcaggattataaacgatgctgatttcggggcgaaaaccggaccatcgtgacactccatctagcgagcacggcacccaaacacacaccagagggggagtcacgaacaaaaactcggagggaccgaaacctcctccagagagcagtattgagacccaccccccaagggacataagtataaccccaccgcgcggcgtactcaagggtgccacacacagccacgcaccatatcgccgccgccaaacaaatacacaccccgccgcatcgcacgtgaaaaaataaaccgagcagggaaatacatcggacaaacaaccgc

SEQ ID NO: 371116 - DNA, 6494 bp, Homo sapiens
agttcgacggagactctctctcggttcgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371117 - DNA, 6346 bp, Homo sapiens
aattccagctcggtatcctccactgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371118 - DNA, 6726 bp, Homo sapiens
atgggattgtctttttccctttttccccttaggaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371119 - DNA, 7432 bp, Homo sapiens
cagcagctcggtggccgagtcggtcccgcggccggcggatcgggcgcgcgcgtcgggggtcgtccggctgccaggcagggcgagcacgcgccggggtgcgcaagggggaccgcatcctggaggtgtgagtatcggggctacccgccgccccatcctccccgcgcctccatgcccctgcatgtccttcgctacccttgtcatcccccatagccgtagcgtcccctcgatgctcctgacgtccggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggtaattctgaacagtccttgaattgaccttttcatctttttgtttctttaaaatttataggcctgtggccaaatacctgggaccctcacctccatctctgtctttctaggaatagaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371120 - DNA, 6541 bp, Homo sapiens
cagcagctcggtggccgagtcggtcccgcggccggcggatcgggcgcgcgcgtcgggggtcgtccggctgccaggcagggcgagcacgcgccggggtgcgcaagggggaccgcatcctggaggtgtgagtatcggggctacccgccgccccatcctccccgcgcctccatgcccctgcatgtccttcgctacccttgtcatcccccatagccgtagcgtcccctcgatgctcctgacgtccggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371121 - DNA, 6373 bp, Homo sapiens
cagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctggtctctcactggccttccctcgtgcca

SEQ ID NO: 371122 - DNA, 3132 bp, Homo sapiens
cggcccgagttacttccgcagtctgactcctcaccttccttctttctctttctctttctttcgaaagaaagagaaagaaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371123 - DNA, 6010 bp, Homo sapiens
cagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggaggctttgtgccctctgggctttatatgggtccatgtttcaatttttcccccccggcttttcctttggcttaacacacgggccgttgtg

SEQ ID NO: 371124 - DNA, 3084 bp, Homo sapiens
ggcgcgaattcactagtgattagagactgcgagaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371125 - DNA, 841 bp, Homo sapiens
ctaggatgcagttcccattcaatgaaaactacctcctaggagcccagcccagaagttggcaaaattctgagataggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371126 - DNA, 5599 bp, Homo sapiens
atgaggtgtcagtggccaagagaggtgctcgtcgaaaccgggagagacccgaggtaaactccccaatcatcagcagagctcgaggttctcggctcaagggagaagaggatatagtagggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaaagcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaaca

SEQ ID NO: 371127 - DNA, 4534 bp, Homo sapiens
cagcagctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgcctttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttcacccctccctttcacaggggtctgggtgcctcacagggtgggggccggcgcctgctaacctcattaccactgatcccttgatcccgtgggctgctccagtgggcaggggtagctagcgtgtgccaggcagatcctctggacacgtaacctatgtcagacactacatgatgactcaaggccaataataaagacatttcctacctgcacaaaacacaaaaaaa

SEQ ID NO: 371128 - DNA, 2551 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatgggtcttgttccatgtgtt

SEQ ID NO: 371129 - DNA, 2730 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgtgagcgcccgcggggcggtggtcctgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371130 - DNA, 2810 bp, Homo sapiens
ttcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacatctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371131 - DNA, 2429 bp, Homo sapiens
tccaggatcttagggaatcgtggtgctgctctagtcggtatgcctaccatggtgaccacgggtgacggggaatcagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371132 - DNA, 2818 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371133 - DNA, 945 bp, Homo sapiens
ccaggctggtaccggccgcaggtcctatgatcgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371134 - DNA, 1503 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctcca

SEQ ID NO: 371135 - DNA, 947 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcctgatttttggtccatctgacccatcgtaacctgaa

SEQ ID NO: 371136 - DNA, 1051 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagc

SEQ ID NO: 371137 - DNA, 2531 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371138 - DNA, 2757 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaaaaaaaaaaaaaaaaaaaaaaaaaaaaaaaaataaaaaaaaaaaaaaaaaataaacaaaaaattataaaaataaaaaactaattaaaattaaatatccctgggggggggccccgggcccaattcccccatttgggggggggtataaaataacattggcccgctttttataaactggggaaaaaggagaaaactccttggggtttcccacaaatatataatttgcctg

SEQ ID NO: 371139 - DNA, 2523 bp, Homo sapiens
  misc_feature (6)..(6): n is a, c, g, or t
  misc_feature (10)..(11): n is a, c, g, or t
  misc_feature (16)..(16): n is a, c, g, or t
  misc_feature (34)..(34): n is a, c, g, or t
  misc_feature (41)..(41): n is a, c, g, or t
  misc_feature (49)..(49): n is a, c, g, or t
  misc_feature (52)..(53): n is a, c, g, or t
  misc_feature (87)..(87): n is a, c, g, or t
  misc_feature (90)..(91): n is a, c, g, or t
  misc_feature (105)..(105): n is a, c, g, or t
  misc_feature (107)..(108): n is a, c, g, or t
  misc_feature (114)..(114): n is a, c, g, or t
cctgtngcgnngggtncgatcgtcgcggtgtctngcttgtnccgagcgncgnngtgcctggcctcgcatacatgggtgctgctgtgntcnnttgcgcttcctagntnnttctcngcgcgcgtgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371140 - DNA, 3750 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagcccaggtcaccccaggttaagcggttcctcagcctcagggctttgtgactcgggccccaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatccggtgtgtcttcgtggatgcacccgctttggggtagctcagtactgcatagaatggccggaccagtccaacctgctccagactgctgggtgtctgagttgttcccggccaatgtgttggtccctcactggacatccttgtttttgtggcttgcacatgtgttcagtatgaccgcacacattcctagcagacaaattccttggtcaaagaatattgatactgaattgccctccacaaactaaattcaaaatcccattatcaatagcctatgtttcttggacctttccagctcagaagctttgtgatcttaatccaatacagtatttttttaaaatgatatctagctctgccccgcagacatctgtgtgagaatgcaaataagcacaggaccccaacagggcagccaccccttcaggctccctggcccgctttctgccttcctgggctggagaggccagtgctggccccagcgcccctgatgggaggtgagagtgctgcgcaggggtggcccaagacagcaggataccatggctgcaaacaccagcagcccccagcttcatctgcatcatctcgtaaccacttggcagcaggcagttattttcccacttatccatgaagccccagccctggagccttccttagagaagcaggttggaggcgacgacacttgccttcccgaggccctcttgtcaggcagcagagggtgaatatggggaggtgaatagatgctccctccttcatctcccaaacggtggctggccccttgggatgagacaggcctgtcagtttacacgggtagtggattgacctatgtgtgtgtccatgtctgggccctcagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371141 - DNA, 2290 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgacctgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371142 - DNA, 839 bp, Homo sapiens
  misc_feature (27)..(27): n is a, c, g, or t
  misc_feature (31)..(31): n is a, c, g, or t
  misc_feature (36)..(36): n is a, c, g, or t
  misc_feature (39)..(39): n is a, c, g, or t
cggggcgggggagagcggggccggcancgcncagcncgncgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaa

SEQ ID NO: 371143 - DNA, 1234 bp, Homo sapiens
ggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagccgcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagcgtaatcccgtagagcgtaatcccgtctaggagtaatc

SEQ ID NO: 371144 - DNA, 405 bp, Homo sapiens
atcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccag

SEQ ID NO: 371145 - DNA, 1074 bp, Homo sapiens
atagccatcacctaggctggatgcagtggctcacgcctgtaatcccagcgctttgggaggccgaggcaggctgattatgaggtcaggagttcaagaccatcctggccaacatggtgaaaccctgtctctactaaaaatacaaaaatttagctgggcgtggtggcaggcacctgtaatcccagctacttgggaggttgaggcaagagaatcgcttgaacccgggaggcggagattacagtgagccgagaccgcgccactacactccagcctgggcaacagagcaagactgtctcaaaaacaaacaaacagaaaatacacacactacacgacagcagcgcatcgagctatcctgggtctaaggagataatatacctgtggtaatgtgtgatcctcccaggtttacaggtcttgactcagtacttcatcagcaataggttgtggtcacaggaaatggaagctgcctcaggacctgtagcaacttgcctgcatgctgggttatgttatcttttgagtggtgcccaatacgaggtgtctaggggaaagtcttaagtggttggagcccatgacatttgggtatgatgactagattctttgtacagctgagcctcaataaactcatgcgtacacttgtgagaactcaaatcagaaatggcacagaaatggattacatttctgtgctctgaaatcccacagagttcataaaaatacatttgttgcttttgtgtatacatgtgtaagttacattttattatggaaattgatattagtgaaattgacagctttctatggttaaagattatcctgtaggtgagccaaggttctctgtttttctgatttctcttattcattccctataatttcagcattttcgttctcattgacttaatattcctgagggtattattgtgaatgtctttgtttatgttaactccatacttcaatactttatgtagttttctaataacaccttcagtatgtgttctaatgaaaattttagcagagcacctgccctttctgggtaggtaattatttttttttgttatgaacttttcctatgccatttgaatttctgtg

SEQ ID NO: 371146 - DNA, 372 bp, Homo sapiens
gtttaacttcaacactattgttggttttttgggggaaagtgcagagtgttgttaatgttggcaggcaggagggcaacacttggtctgtccacgaagcctccttcatctctagttctgactgagggttgactgttagccttcggtttcctttgtcactgtattgtaggggttattttaaaatattatcttcaatttatactttattattattatcattattttgaaaagggtcttgctttgtcgcccaggctggagtacagtggtgcaatcacagctcactgcagcctcgacatcctgggctcaagtgatccttccactttggcctcccgagtagccggaactataggtgtgtgccaccatgcccagctaatt

SEQ ID NO: 371147 - DNA, 1724 bp, Homo sapiens
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371148 - DNA, 721 bp, Homo sapiens
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatacctgggaaaaaaaaaaaaaacacaaaaaaaaaaaaaaaaaaaaaaaaaaccgcgggggggctatttgggggggggcgaaaaaaagagaaaaaaaagggacacaagggcaaagggggtaccgagaccccaattgttgagcacagagggaaagaacgcggggaccccaaaaagagagcgagcaaaacatgagaagaacgaggtaaacccggtatag

SEQ ID NO: 371149 - DNA, 1444 bp, Homo sapiens
ggactcaatctccagactatctccccagagaatcttgtcaaggcttggctttaagctttgttgggaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371150 - DNA, 1951 bp, Homo sapiens
ctctcttcctgcttctgctatcttcctggcgcaccctgctggcgcaagtagccttgagccttgggactgggcctgagaagggaagagtttttctttcatctccttaagctttcaggccccggggagaatcttacattcctgtctatttggttatagaaaagggaaaagggatgactttctcaataactacttcaggcgtgacataggggtggcgtgggcaccttggaaaaagaaaaccttaattttttgggtattcttgagagacgggctggtgtccaccatgtcgttgtatcaggagcatcatctggattgtctggaaacacatctgtgcctgcaagacagttatgttgagaggacaaggcggtgtggacagggagaggcatggcctcatttgctgcttcacaaatgaaagaccctgtctggattaaggagggaagttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371151 - DNA, 1559 bp, Homo sapiens
tgcccataagagccctactccacaagtttaaatgcatacccacgtcaagggctttttccaacaccaattttgcgaccttaagaccccagtggatttctttaataacgcccccgccccatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371152 - DNA, 1652 bp, Homo sapiens
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371153 - DNA, 1733 bp, Homo sapiens
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttggtgtactaggatctgtctgcttgtgagcgtggcgtctttcccatcgtcgaacgcggtcattgttactacccttgattcacaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371154 - DNA, 1499 bp, Homo sapiens
ctccttgcctcagtcggccgtattctttccgcgccaccgttgttaggaggtaccgaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371155 - DNA, 1670 bp, Homo sapiens
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagtgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371156 - DNA, 1508 bp, Homo sapiens
aagcacacttataatattacgagtagtaacttctcataaaaaagaaagaataaatgctactaggctacctgtagctgtgaaaatgaactgtaaagtagactaaaatatctttagagtcggaatatagagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371157 - DNA, 1494 bp, Homo sapiens
  misc_feature (51)..(51): n is a, c, g, or t
aagtacgcgcacgacgatcgctctcagaggatctaacctccccaccttcantatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371158 - DNA, 745 bp, Homo sapiens
  misc_feature (708)..(708): n is a, c, g, or t
cactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaantggcctcgttggcctcagcggtggagctctgcggcag

SEQ ID NO: 371159 - DNA, 1495 bp, Homo sapiens
acggcgtacaaagaaaaatacgaggacgaaagcaagccttttaggtaacctggatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatactattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacagagtcacgtattccactctccaactacccacatattccttttgcaatagccattagggcatcattttgatatttcattctgatttctgattctctgatttctgattcctaatgaggacagtaggtctggatccaaattctcacagtaaaatcaagcagtaattttctctcatatctattaggggaaagaaaaatgatcacagtctgctaagagtcttgattttctttgtaatgcctcacatagtatgataatcagtctccaaagcatcacatgataattacaatgataccattaacatgtcaaggaaattatattatttatggttgtcaaaaattatgaagtagtgtatgattataagcagatatggcaaatttgtgcagtaaatccatagatgactacattttgagaaatactaagataatactaaaaattatgccttagcataatttgcatgcaaaattgccctctagtgtttttgttttgttttgagacatagtctcgctctgttcgcccaggctggagtgcaggggcacgatctctgctcactgcaagctctgcttcccgggttcacaccattctcctgcctcagcatcctgagtagctgggactacaggcacatgctgtcacacccggctaattttttgtatttagtagagatggggtttcaccacgttagccaggatggtctccatctcctgaccttgtgatccgcccacctcggcctcacaaattgctgggattacaggtgtgagccaccacgcctggccgaaagttagttgttttgaactcattttctcctttttacccctgcctttatcagcttctaccttctggtttcatgctgagttctagttgcctaaagtctccattgaaacactcctgttataattgccataaaatcataaatccactccccctttctcctcctagtcaaaatttgtattcttttcagcaggttggttttaataaaaagtaaattaagttgaaaaaaaaat

SEQ ID NO: 371160 - DNA, 4912 bp, Homo sapiens
ctcccaagttgctgggactacaggcacgcaccaccacgccggccatttttttactttttgttgaattttaagggacctcaagtgaaataataatcggtgaattcaggatcaacctttatgtccagagcgtttgttccgtcgtccatttcttgtctagagtagtggtatgagctgaaaacattgctaagtgatcaccacatattgttgatgtaagggctaccggttattacaagagatttttatgactcctgctgtgggggtgccctttctacccggctgagcttggtgggagccaaggctgagtcggatgtatctttatattcccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgctctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctctgagactttgcatggatccgcggtggggagctgcccccacacaaacgtccggctcttctcaggccaggtggctgccctgacatggcatgatgtccagcgcatggacgtcacccttgcactggagcccagccaaccgctgcatgacagccctcttcccccttgaaccccaagtctgcacacaccagtgcctcctcttcctggatcctcctgatggcctgtacacagaactggggtgtgggtggtgggtttttaaatgaaaaccagtccacacatgcttgagggctggagccgcctgccgtcagggcagtgccatgctgacctgctgaccgttccattttgtcaaggctcatgagcaattttaaatgtttactcgtgggtgaaggtttttgtttcagctgtaccccctatagcagggccatggggagcctaagaggttctccttggcacctgtgcgcgctctgctgttgccggtgagtctgaaattccagggaatgccgtgaggggccctctggcgtttgttcttggacaaatgtgctttcacccccattaagccctgcttgttggtcttcatttcatttgtgctgcgctgcccctcctgagggacagacgctcaggcagtgcttccttccagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371161 - DNA, 502 bp, Homo sapiens
ggatctcggagggggtttcccttagttctgtccctcccctgagaactgcgaggggattgggcagacctgtccggatcccgcctactcctgcctttctcactcccttgactctgccgcccaggaagagaagaagcggaagcgagagagggagcactgtgacacggagggagaggctgacgactttgatcctgggaagaaggtggagggtgtggtgtcatcttttctgaggccttattccccacgccagcctcgtcagctgtgaaacagaccctgcaccttctcttggtgactcccagtccacttcggggtgcgtaggaagagttcatgaactcattagtggctcactctgaagtcagagtagagtgagggaagtcaaggctagagctgggacattgatggccgccaggatgcgttgggggaatttttattatatctgaaatacctatcacaataaattaaaagacgctcgtaacttttttatttttaagaaacaaaattcggt

SEQ ID NO: 371162 - DNA, 2677 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371163 - DNA, 3742 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaagggtttgctgactcacagaaacacaacagaacagacttaaaggagagtgggagaaaaggaaactcgatgagaggatcaggcagcgcctgagggtagatgttaagagcactccatgcccgaaagccctctgtattccctgcttcgggccccagtctggccattcctagcaacaaagcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggagacgttctagacccagtgtcttcagtggaaacagagcacaggctgtctgcagtctcaggcttcctagcagccctgataagagaagtagagcaatgcagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggttagtcggaagcacagaccacagcctggggctttcagttggcatcagccggtggggccatcctggagactgtgccctcacctgggaggctgccggtgcagcgcccccgagctgttctgacctccagcagcatttgtggtgcctggatccatgggtcccactgctttgcgtggtgacgttccacctgtctctgctggctctgttcaggcacttatggccgtgatttattataggggaagggtgccaacagcagcagagggacaagagtgacatccaaggaaacccagcgtgaggcccagatccactcccagcagaggcacatgggacacgcttaattcccaggagtgagctgtgacaacacacgtgaaatgcccaccagggaagcccgtcagaggcttggtgctcggggtcacagggcacccccttgccagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371164 - DNA, 3343 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaaggtagtgctctgtggccaccgagagagggtgccacgtggccccagactctctgtgtgcctctccttctgggttggtgctgtgtgatctagcacagccaccgggatccagaggtcagcgtggggccctgacgggaggtccggatcagacacacataaggctggtctcttcagtcggggtccaggtgcctctggcagggctgccgctggtgtttcatgcatcgtggaggccacgtggtcactgacctcatttccttgatggaggccctgctgcaggctaatcctttctcttggagtgaatgctgacttctgtgtctctgtcactgggtgttgacgtgaggcaccgcccttgttattccagtgggggtgctggtgttggatccgacagatggtccataataggccaccgactgtgttcacgtggctcctgccacagatggtctttgtggtggtggggcccactcagctgaccacgctctcctttctggcaggagacgttctagacccagtgtcttcagtggaaacagagcacaggctgtctgcagtctcaggcttcctagcagccctgataagagaagtagagcaatgcaggtgacattaatccttgcagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371165 - DNA, 2725 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcaggtgtcccccggagaccgtgactgtgtgctcaccactcccagcgcactcagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371166 - DNA, 865 bp, Homo sapiens
gatcccgatctgggtcacgctcgacagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371167 - DNA, 2971 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgtttactgagtgcccatttatgttagtatttgcaaaataccataaacacagcttccagtcacaagacacagagcgccaaagtgcacccaactgctcccagcacgcgagggtgctgtgtcctaccagctggtggtggtcctctggcccagctgtcgtgccacagtgacatcaggtgcacctgtgcgcccaccagcacctcctgcagggtggcctggtctgtgaccatggaacttgaaagtgaagaagcacaccttccagaggcaggctggatgggagctcagtcgtcctggggg

SEQ ID NO: 371168 - DNA, 509 bp, Homo sapiens
ctgtagaggcgactactagaggatccccccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371169 - DNA, 2542 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacagacgacggccagccgcacacgcatgtcatgcaccacagccgactgttacgaggatactcacccagatcgcacaggcagcccatggcaaccgcctaaacggg

SEQ ID NO: 371170 - DNA, 2523 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtccaggtctcgtacgccagacgcgacgctgcagcacgacggccagtccctagagacaacgctgtcagctcgactgctagaggattcgcctcacagcggacgaagcggtgcattgagtgtagtcccgccttctgtttcgtgatcaatatctagagtgcgctataagactgtgatctagtac

SEQ ID NO: 371171 - DNA, 2509 bp, Homo sapiens
  misc_feature (2416)..(2416): n is a, c, g, or t
  misc_feature (2427)..(2427): n is a, c, g, or t
  misc_feature (2433)..(2433): n is a, c, g, or t
  misc_feature (2440)..(2441): n is a, c, g, or t
  misc_feature (2446)..(2446): n is a, c, g, or t
  misc_feature (2453)..(2453): n is a, c, g, or t
  misc_feature (2458)..(2458): n is a, c, g, or t
  misc_feature (2468)..(2469): n is a, c, g, or t
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggggaagggtgccaacagcagcagagggacaagagtgacatccaaggaaacccagcgtgaggcccagatccactcccagcagaggcacatgggacacgcttaattcccaggagtgagctgtgacaacacacgtgaaatgcccaccagggaagcccgtcagaggcttggtgctcggggtcacagggcacccccttgccagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttagtnattggcggtangttggncaacagnntgtcngccctgntgganaccgggggannattgtggttttcattcccaccggtggtaccgcttccttaa

SEQ ID NO: 371172 - DNA, 804 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggagggtgtggtgtcatcttttctgaggccttattccccacgccagcctcgtcagctgtgaaacagaccctgcaccttctcttggtgactcccagtccacttcggggtgcgtaggaagagttcatgaactcattagtggctcactctgaagtcagagtagagtgagggaagtcaaggctagagctgggacattgatggccgccaggatgcgttgggggaatttttattatatctgaaatacctatcacaataaattaaaagacgctcgtaacttttttatttttaagaaacaaaattcggt

SEQ ID NO: 371173 - DNA, 394 bp, Homo sapiens
aaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggttcacgtggcttgcatgttgggaagttgctgtggtctgcgtggcttatgtgttgggaggttgtggtttgtgtggcttgtgtgttgggaggttgcagtctgcgtggctcg

SEQ ID NO: 371174 - DNA, 2856 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371175 - DNA, 2696 bp, Homo sapiens
ggtcctgggcaccgggcgaggtcctggccacgagggaggggttctgggcacgcgggagggggtcctgggatttcgggcagggaaccgggcacacgtgaggggtcctggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371176 - DNA, 2737 bp, Homo sapiens
ccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371177 - DNA, 3455 bp, Homo sapiens
  misc_feature (40)..(41): n is a, c, g, or t
gtatctagagcatccccttagacggtaccaacaggcggcnnggagacgttctagacccagtgtcttcagtggaaacagagcacaggctgtctgcagtctcaggcttcctagcagccctgataagagaagtagagcaatgcaggtgacattaatccttgcaggtttcatttcacctctatatccaacattttatctcaacatgtagtctgtagaaaacgttaatttgagctttatgggtttttttcatattaagtcttcaaaatgcacatgggatgggatgtaaagaacgctgaagtgggggcatttcagaggtgtctgctgctttttgcctgtgcctgctgggaagttgcagtgctctgtgtggcttgcgtgttgcgaggttgcggtctgcgtggctcacgtgttgggaggtcgtggtctgcgtggctcacgtgttgggaagttgcagtggtctgtatggcttgcgtgttgggaggttgcagtctgtgtggcccgtgtgttgggaggttgtggtctgcgtggcttgtgtgttgggaggttgtggtttttgtggcttgcgtgttggggggttgtggtctgtgtggctcacgtgttgggaggttgtggtctgcgtggctcacgtgttgggcagttgtctgcttggctcacgtgttgggaagttgtggtctgcgtggctcatgtgttgggaagttgtttatgtggcttgtgtgctggaggttgtggcctgcgtggctcacgtgttgggcggttgtctgcttggctcatgtgttgggaagttgtggtctgcgtggcttgtgtgttgggaagttgtttatgtggcttgtgtgctggaggttgtggtctacgtggcttgcactgtagttcttttggacagccttgctctgcagtctgtgtttcagccctggaattgccacattctccaagaagccctggtttcttgactagagagccttgtgtagaagccaggacctgggttctgggtgaagccctctgcagatagagctgggagatgcctgttgtgtgtgtctgcaccacatacatggacactgtgcagagggattctgttggcacctgtgtttacatgggttgaaaactgtttttacacggaaacttccagttccctcgtgccccgtgggttccgcccacttcttccctttcagttttgtatctgcgccgtgaggacttgtctcctaatcttcgtatcaactccgtgtcccattgagctgaccttccgcctctcccccagggccctggccatcctgtgggctctgagactttgcatggatccgcggtggggagctgcccccacacaaacgtccggctcttctcaggccaggtggctgccctgacatggcatgatgtccagcgcatggacgtcacccttgcactggagcccagccaaccgctgcatgacagccctcttcccccttgaaccccaagtctgcacacaccagtgcctcctcttcctggatcctcctgatggcctgtacacagaactggggtgtgggtggtgggtttttaaatgaaaaccagtccacacatgcttgagggctggagccgcctgccgtcagggcagtgccatgctgacctgctgaccgttccattttgtcaaggctcatgagcaattttaaatgtttactcgtgggtgaaggtttttgtttcagctgtaccccctatagcagggccatggggagcctaagaggttctccttggcacctgtgcgcgctctgctgttgccggtgagtctgaaattccagggaatgccgtgaggggccctctggcgtttgttcttggacaaatgtgctttcacccccattaagccctgcttgttggtcttcatttcatttgtgctgcgctgcccctcctgagggacagacgctcaggcagtgcttccttccagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg

SEQ ID NO: 371178 - DNA, 1947 bp, Homo sapiens
tagaggatcccactcgatccgtgacctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggtttctttcagggcctgccatctatcacgtgatgctgtactaaagtcggatcggaatttggtgtcttattaccacggagtctgctttgtcaaccttcagatttctgttttaaagttaatgctggtcagctgtgcctgaattccaaaagaggggataatgagatgtttccctgacttctgtgagtcactctaggaaattcatagagctcaagtctggtcttctgggaaccccatttgatagctggttagtcggaagcacagaccacagcctggggctttcagttggcatcagccggtggggccatcctggagactgtgccctcacctgggaggctgccggtgcagcgcccccgagctgttctgacctccagcagcatttgtggtgcctggatccatgggtcccactgctttgcgtggtgacgttccacctgtctctgctggctctgttcaggcacttatggccgtgatttattataggggaagggtgccaacagcagcagagggacaagagtgacatccaaggaaacccagcgtgaggcccagatccactcccagcagaggcacatgggacacgcttaattcccaggagtgagctgtgacaacacacgtgaaatgcccaccagggaagcccgtcagaggcttggtgctcggggtcacagggcacccccttgccagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactggg
